United States Patent
Kulkarni et al.

(10) Patent No.: US 12,239,710 B2
(45) Date of Patent: Mar. 4, 2025

(54) FN3 DOMAIN-siRNA CONJUGATES AND USES THEREOF

(71) Applicant: ARO BIOTHERAPEUTICS COMPANY, Philadelphia, PA (US)

(72) Inventors: Swapnil Kulkarni, Philadelphia, PA (US); Russell C. Addis, Philadelphia, PA (US); Steven G. Nadler, Philadelphia, PA (US); Yao Xin, Philadelphia, PA (US); Zhanna Druzina, Philadelphia, PA (US); Karyn T. O'Neil, Philadelphia, PA (US); Robert V. Kolakowski, Philadelphia, PA (US); Stephen J. Anderson, Philadelphia, PA (US)

(73) Assignee: ARO BIOTHERAPEUTICS COMPANY, Philadelphia, PA (US)

( * ) Notice: Subject to any disclaimer, the term of this patent is extended or adjusted under 35 U.S.C. 154(b) by 0 days.

(21) Appl. No.: 17/720,996

(22) Filed: Apr. 14, 2022

(65) Prior Publication Data
US 2022/0370626 A1 Nov. 24, 2022

Related U.S. Application Data

(60) Provisional application No. 63/324,437, filed on Mar. 28, 2022, provisional application No. 63/203,776, (Continued)

(51) Int. Cl.
*A61K 47/54* (2017.01)
*A61P 21/00* (2006.01)
*C12N 15/113* (2010.01)

(52) U.S. Cl.
CPC ............ *A61K 47/549* (2017.08); *A61P 21/00* (2018.01); *C12N 15/1137* (2013.01);
(Continued)

(58) Field of Classification Search
CPC .. A61K 47/549; A61K 47/64; A61K 47/6435; A61K 31/713; A61K 47/60;
(Continued)

(56) References Cited

U.S. PATENT DOCUMENTS

| 4,281,061 A | 7/1981 | Zuk et al. |
| 5,223,409 A | 6/1993 | Ladner et al. |

(Continued)

FOREIGN PATENT DOCUMENTS

| CN | 102076713 A | 5/2011 |
| CN | 103827361 A | 5/2014 |

(Continued)

OTHER PUBLICATIONS

U.S. Appl. No. 18/301,036, filed Apr. 2023.*
(Continued)

*Primary Examiner* — Kimberly Chong
*Assistant Examiner* — Ruth Sophia Arieti
(74) *Attorney, Agent, or Firm* — Goodwin Procter LLP

(57) ABSTRACT

The present disclosure relates to compositions, such as siRNA molecules and FN3 domains conjugated to the same, as well as methods of making and using the molecules.

57 Claims, 10 Drawing Sheets
Specification includes a Sequence Listing.

Related U.S. Application Data filed on Jul. 30, 2021, provisional application No. 63/174,776, filed on Apr. 14, 2021.

(52) U.S. Cl.
CPC ...... *C12N 2310/11* (2013.01); *C12N 2310/14* (2013.01); *C12N 2310/3125* (2013.01); *C12N 2310/315* (2013.01); *C12N 2310/321* (2013.01); *C12N 2310/322* (2013.01); *C12N 2310/346* (2013.01); *C12N 2310/3513* (2013.01)

(58) Field of Classification Search
CPC ...... A61K 48/0041; A61P 21/00; A61P 35/00; A61P 37/00; C12N 15/1137; C12N 2310/11; C12N 2310/14; C12N 2310/3125; C12N 2310/315; C12N 2310/321; C12N 2310/322; C12N 2310/346; C12N 2310/3513; C12N 2320/32; C12N 15/1138; C07K 14/78
See application file for complete search history.

(56) References Cited

U.S. PATENT DOCUMENTS

| | | | |
|---|---|---|---|
| 5,643,763 A | 7/1997 | Dunn et al. | |
| 5,643,768 A | 7/1997 | Kawasaki | |
| 5,658,727 A | 8/1997 | Barbas et al. | |
| 5,691,157 A | 11/1997 | Gong et al. | |
| 5,846,456 A | 12/1998 | Liu | |
| 5,856,456 A | 1/1999 | Whitlow et al. | |
| 6,018,030 A | 1/2000 | Ferrari et al. | |
| 6,162,903 A | 12/2000 | Trowern et al. | |
| 6,172,197 B1 | 1/2001 | McCafferty et al. | |
| 6,355,776 B1 | 3/2002 | Ferrari et al. | |
| 6,462,189 B1 | 10/2002 | Koide | |
| 6,472,147 B1 | 10/2002 | Janda et al. | |
| 6,521,427 B1 | 2/2003 | Evans | |
| 6,582,915 B1 | 6/2003 | Griffiths et al. | |
| 6,670,127 B2 | 12/2003 | Evans | |
| 6,673,901 B2 | 1/2004 | Koide | |
| 6,703,199 B1 | 3/2004 | Koide | |
| 6,818,418 B1 | 11/2004 | Lipovsek et al. | |
| 6,846,655 B1 | 1/2005 | Wagner et al. | |
| 6,969,108 B2 | 11/2005 | Fukumoto et al. | |
| 7,078,490 B2 | 7/2006 | Koide | |
| 7,115,396 B2 | 10/2006 | Lipovsek et al. | |
| 7,119,171 B2 | 10/2006 | Koide | |
| 7,153,661 B2 | 12/2006 | Koide | |
| 7,288,638 B2 | 10/2007 | Jure-Kunkel et al. | |
| 7,427,672 B2 | 9/2008 | Imanishi et al. | |
| 7,709,214 B2 | 5/2010 | Freeman et al. | |
| 7,794,710 B2 | 9/2010 | Chen et al. | |
| 7,842,476 B2 | 11/2010 | McGregor et al. | |
| 7,943,743 B2 | 5/2011 | Korman et al. | |
| 8,217,149 B2 | 7/2012 | Irving et al. | |
| 8,278,419 B2 | 10/2012 | Jacobs et al. | |
| 8,293,482 B2 | 10/2012 | Jacobs et al. | |
| 8,552,154 B2 | 10/2013 | Freeman et al. | |
| 8,569,227 B2 | 10/2013 | Jacobs | |
| 8,741,295 B2 | 6/2014 | Olive | |
| 8,779,108 B2 | 7/2014 | Queva et al. | |
| 8,981,063 B2 | 3/2015 | Chen | |
| 9,156,887 B2 | 10/2015 | Jacobs | |
| 9,175,082 B2 | 11/2015 | Zhou et al. | |
| 9,200,273 B2 | 12/2015 | Diem et al. | |
| 9,212,224 B2 | 12/2015 | Cogswell et al. | |
| 9,326,941 B2 | 5/2016 | Chae et al. | |
| 9,546,368 B2 | 1/2017 | Bennett et al. | |
| 9,644,023 B2 | 5/2017 | Torres et al. | |
| 9,695,228 B2 | 7/2017 | Mark et al. | |
| 9,897,612 B2 | 2/2018 | Diem et al. | |
| 10,196,446 B2 | 2/2019 | Goldberg et al. | |
| 10,233,448 B2 | 3/2019 | Maier et al. | |
| 10,597,438 B2 | 3/2020 | Diem et al. | |
| 10,611,823 B2 | 4/2020 | Diem et al. | |
| 10,626,165 B2 | 4/2020 | Hawkins et al. | |
| 10,781,246 B2 | 9/2020 | Brezki et al. | |
| 10,925,932 B2 | 2/2021 | Diem et al. | |
| 11,628,222 B2 * | 4/2023 | Addis ............... C07K 14/78 514/9.3 |
| 11,781,138 B2 | 10/2023 | Addis et al. | |
| 2004/0197332 A1 | 10/2004 | Ullrich et al. | |
| 2004/0259781 A1 | 12/2004 | Chiquet-Ehrismann et al. | |
| 2005/0004029 A1 | 1/2005 | Garcia | |
| 2005/0038229 A1 | 2/2005 | Lipovsek et al. | |
| 2005/0255548 A1 | 11/2005 | Lipovsek et al. | |
| 2005/0272083 A1 | 12/2005 | Seshagiri | |
| 2006/0040278 A1 | 2/2006 | Cojocaru et al. | |
| 2006/0246509 A1 | 11/2006 | Lipovsek et al. | |
| 2006/0270604 A1 | 11/2006 | Lipovsek et al. | |
| 2007/0148126 A1 | 6/2007 | Chen et al. | |
| 2007/0160533 A1 | 7/2007 | Chen et al. | |
| 2007/0184476 A1 | 8/2007 | Hsieh et al. | |
| 2008/0015339 A1 | 1/2008 | Lipovsek et al. | |
| 2008/0220049 A1 | 9/2008 | Chen et al. | |
| 2008/0241159 A1 | 10/2008 | Gerritsen et al. | |
| 2009/0042906 A1 | 2/2009 | Huang et al. | |
| 2009/0176654 A1 | 7/2009 | Cappuccilli et al. | |
| 2009/0274693 A1 | 11/2009 | Gilmer et al. | |
| 2009/0299040 A1 | 12/2009 | Camphausen et al. | |
| 2009/0311803 A1 | 12/2009 | Way et al. | |
| 2010/0093662 A1 | 4/2010 | Defaye et al. | |
| 2010/0136129 A1 | 6/2010 | Agueros Bazo et al. | |
| 2010/0144601 A1 | 6/2010 | Jacobs et al. | |
| 2010/0179094 A1 | 7/2010 | Emanuel et al. | |
| 2010/0203142 A1 | 8/2010 | Zhang et al. | |
| 2010/0216708 A1 | 8/2010 | Jacobs et al. | |
| 2010/0221248 A1 | 9/2010 | Wittrup et al. | |
| 2010/0254989 A1 | 10/2010 | Bossenmaier et al. | |
| 2010/0255056 A1 | 10/2010 | Jacobs et al. | |
| 2011/0021746 A1 | 1/2011 | Cappuccilli et al. | |
| 2011/0038866 A1 | 2/2011 | Hastewell et al. | |
| 2011/0053842 A1 | 3/2011 | Camphausen et al. | |
| 2011/0081345 A1 | 4/2011 | Moore et al. | |
| 2011/0118144 A1 | 5/2011 | Hyun et al. | |
| 2011/0124527 A1 | 5/2011 | Cappuccilli et al. | |
| 2011/0274623 A1 | 11/2011 | Jacobs | |
| 2011/0287009 A1 | 11/2011 | Scheer et al. | |
| 2012/0225870 A1 | 9/2012 | Janne et al. | |
| 2012/0244164 A1 | 9/2012 | Beste et al. | |
| 2012/0263723 A1 | 10/2012 | Davies et al. | |
| 2012/0270797 A1 | 10/2012 | Wittrup et al. | |
| 2012/0315639 A1 | 12/2012 | Deng et al. | |
| 2012/0321666 A1 | 12/2012 | Cooper et al. | |
| 2013/0012435 A1 | 1/2013 | Camphausen et al. | |
| 2013/0039927 A1 | 2/2013 | Dewhurst et al. | |
| 2013/0079243 A1 | 3/2013 | Diem et al. | |
| 2013/0123342 A1 | 5/2013 | Brown | |
| 2013/0130377 A1 | 5/2013 | Lee et al. | |
| 2013/0184212 A1 | 7/2013 | Camphausen et al. | |
| 2013/0226834 A1 | 8/2013 | Gannalo, II | |
| 2013/0273561 A1 | 10/2013 | Walker et al. | |
| 2014/0141000 A1 | 5/2014 | Chiu et al. | |
| 2014/0155325 A1 | 6/2014 | Mark et al. | |
| 2014/0155326 A1 | 6/2014 | Mark et al. | |
| 2014/0255408 A1 | 9/2014 | Chiu et al. | |
| 2014/0271467 A1 | 9/2014 | Hackel et al. | |
| 2014/0341917 A1 | 11/2014 | Nastri et al. | |
| 2014/0349929 A1 | 11/2014 | Camphausen et al. | |
| 2014/0371296 A1 | 12/2014 | Bennett et al. | |
| 2015/0005364 A1 | 1/2015 | Chae et al. | |
| 2015/0104808 A1 | 4/2015 | Goldberg et al. | |
| 2015/0118288 A1 | 4/2015 | Lee | |
| 2015/0191543 A1 | 7/2015 | Wu et al. | |
| 2015/0197571 A1 | 7/2015 | Freeman et al. | |
| 2015/0203580 A1 | 7/2015 | Papadopoulos et al. | |
| 2015/0210756 A1 | 7/2015 | Torres et al. | |
| 2015/0252097 A1 | 9/2015 | Camphausen et al. | |
| 2015/0274835 A1 | 10/2015 | Marasco et al. | |
| 2015/0346208 A1 | 12/2015 | Couto et al. | |
| 2015/0355184 A1 | 12/2015 | Pierce et al. | |
| 2016/0041182 A1 | 2/2016 | Diem et al. | |

(56) References Cited

U.S. PATENT DOCUMENTS

| | | |
|---|---|---|
| 2016/0303256 A1 | 10/2016 | Liu |
| 2016/0326232 A1 | 11/2016 | Rosa et al. |
| 2016/0347840 A1 | 12/2016 | Anderson et al. |
| 2016/0355599 A1 | 12/2016 | Sagert et al. |
| 2017/0174748 A1 | 6/2017 | Mitchell et al. |
| 2017/0258948 A1 | 9/2017 | Morin et al. |
| 2017/0281795 A1 | 10/2017 | Geall et al. |
| 2017/0348397 A1 | 12/2017 | Diem et al. |
| 2017/0362301 A1 | 12/2017 | Anderson et al. |
| 2019/0070322 A1 | 3/2019 | Bander |
| 2019/0127444 A1 | 5/2019 | Brezski et al. |
| 2019/0175651 A1 | 6/2019 | Lee et al. |
| 2019/0184018 A1 | 6/2019 | Manoharan et al. |
| 2019/0184028 A1* | 6/2019 | Dudkin ............... A61K 9/5123 |
| 2019/0202927 A1 | 7/2019 | Sagert et al. |
| 2019/0256575 A1 | 8/2019 | Chen et al. |
| 2019/0263915 A1 | 8/2019 | Goldberg et al. |
| 2019/0330361 A1 | 10/2019 | Chin et al. |
| 2021/0108201 A1 | 4/2021 | Addis et al. |
| 2021/0145976 A1 | 5/2021 | Addis et al. |
| 2022/0332795 A1* | 10/2022 | Addis ............ C07K 14/70582 |
| 2023/0330246 A1 | 10/2023 | Marelius et al. |
| 2024/0043844 A1 | 2/2024 | Kulkarni et al. |

FOREIGN PATENT DOCUMENTS

| | | | |
|---|---|---|---|
| CN | 105907719 A | 8/2016 | |
| EP | 0985039 A2 | 3/2000 | |
| EP | 1137941 A1 | 10/2001 | |
| EP | 1210428 A1 | 6/2002 | |
| EP | 1266025 A1 | 12/2002 | |
| EP | 2935329 A1 | 10/2015 | |
| EP | 3473270 A1 * | 4/2019 | ......... A61K 31/7088 |
| EP | 4146229 A1 | 3/2023 | |
| JP | 2011507543 A | 3/2011 | |
| JP | 2011517314 A | 6/2011 | |
| JP | 2011520961 A | 7/2011 | |
| JP | 2011522517 A | 8/2011 | |
| JP | 2012507295 A | 3/2012 | |
| JP | 2014530014 A | 11/2014 | |
| JP | 2016504291 A | 2/2016 | |
| KR | 10-2016-0067966 A | 6/2016 | |
| WO | 9638557 A1 | 12/1996 | |
| WO | 2001014557 A1 | 3/2001 | |
| WO | 0164942 A1 | 9/2001 | |
| WO | 0232925 A2 | 4/2002 | |
| WO | 03104418 A2 | 12/2003 | |
| WO | 2004029224 A2 | 4/2004 | |
| WO | 2004058821 A2 | 7/2004 | |
| WO | 2005018534 A2 | 3/2005 | |
| WO | 2005042708 A2 | 5/2005 | |
| WO | 2007000671 A2 | 1/2007 | |
| WO | WO-2007047796 A2 * | 4/2007 | ........... G01N 33/574 |
| WO | 2007085815 A2 | 8/2007 | |
| WO | 2008066752 A2 | 6/2008 | |
| WO | 2008079973 A2 | 7/2008 | |
| WO | 2008127710 A2 | 10/2008 | |
| WO | 2008156642 A1 | 12/2008 | |
| WO | 2009023184 A2 | 2/2009 | |
| WO | 2009058379 A2 | 5/2009 | |
| WO | 2009083804 A2 | 7/2009 | |
| WO | 2009085462 A1 | 7/2009 | |
| WO | 2009086116 A2 | 7/2009 | |
| WO | 2009102421 A2 | 8/2009 | |
| WO | 2009111691 A2 | 9/2009 | |
| WO | 2009126834 A2 | 10/2009 | |
| WO | 2009133208 A1 | 11/2009 | |
| WO | 2009142773 A2 | 11/2009 | |
| WO | 2010037838 A2 | 4/2010 | |
| WO | 2010039248 A1 | 4/2010 | |
| WO | 2010051274 A2 | 5/2010 | |
| WO | 2010051310 A2 | 5/2010 | |
| WO | 2010060095 A1 | 5/2010 | |
| WO | 2010093627 A3 | 10/2010 | |
| WO | 2010115202 A2 | 10/2010 | |
| WO | 2010115551 A1 | 10/2010 | |
| WO | 2011005133 A1 | 1/2011 | |
| WO | 2011110642 A2 | 9/2011 | |
| WO | 2011130324 A1 | 10/2011 | |
| WO | 2011131746 A2 | 10/2011 | |
| WO | 2011137319 A2 | 11/2011 | |
| WO | 2011151412 A1 | 12/2011 | |
| WO | 2012016245 A2 | 2/2012 | |
| WO | 2012162418 A1 | 11/2012 | |
| WO | 2013049275 A1 | 4/2013 | |
| WO | 2014081944 A2 | 5/2014 | |
| WO | 2014081954 A1 | 5/2014 | |
| WO | 2014100079 A1 | 6/2014 | |
| WO | 2014165082 A2 | 10/2014 | |
| WO | 2014165093 A2 | 10/2014 | |
| WO | 2014189973 A2 | 11/2014 | |
| WO | 2014209804 A1 | 12/2014 | |
| WO | 2015057545 A2 | 4/2015 | |
| WO | 2015061668 A1 | 4/2015 | |
| WO | 2015089073 A2 | 6/2015 | |
| WO | 2015092393 A2 | 6/2015 | |
| WO | 2015109124 A2 | 7/2015 | |
| WO | 2015143199 A1 | 9/2015 | |
| WO | 2015195163 A1 | 12/2015 | |
| WO | 2016000619 A1 | 1/2016 | |
| WO | 20160004043 A1 | 1/2016 | |
| WO | 2016086021 A1 | 6/2016 | |
| WO | 2016086036 | 6/2016 | |
| WO | 2016179534 | 11/2016 | |
| WO | 2016197071 A1 | 12/2016 | |
| WO | 2017011618 A1 | 1/2017 | |
| WO | 2017223180 A2 | 12/2017 | |
| WO | 2018148501 A1 | 8/2018 | |
| WO | WO-2019217459 A1 * | 11/2019 | ......... A61K 31/7088 |
| WO | 2021030763 A1 | 2/2021 | |
| WO | 2021030778 A1 | 2/2021 | |
| WO | 2021076546 A1 | 4/2021 | |
| WO | 2021076574 A2 | 4/2021 | |
| WO | 2021226107 A1 | 11/2021 | |
| WO | 2022198196 A1 | 9/2022 | |
| WO | 2022213118 A1 | 10/2022 | |
| WO | 2022221505 A2 | 10/2022 | |
| WO | 2022221550 A1 | 10/2022 | |
| WO | 2023201362 A2 | 10/2023 | |
| WO | 2023215880 A2 | 11/2023 | |

OTHER PUBLICATIONS

U.S. Appl. No. 18/174,751, filed Feb. 2023.*
Gill et al., "Monoclonal Anti-epidermal Growth Factor Receptor Antibodies Which Are Inhibitors of Epidermal Growth racier Binding and Antagonists of Epidermal Growth Factor-stimulated tyrosine Protein Kinase Activity," The Journal Jf Biological Chemistry, vol. 259, No. 12, pp. 7755-7760 (1984).
Goldstein et al., "Biological efficacy of a chimeric antibody to the epidermal growth factor receptor in a human umor xenografl model," Clinical Cancer Research, vol. 1, pp. 1311-1318 (1995).
Grünwald et al., "Developing Inhibitors of the Epidermal Growth Factor Receptor for Cancer Treatment," Journal of he National Cancer Institute, vol. 95, No. 12, pp. 851-867 (2003).
Hirsch et al, "Combination of EGFR gene copy number and protein expression predicts outcome for advanced non- , mall-cell lung cancer patients treated with gefitnib," Annals of Oncology, vol. 18, pp. 752-760 (2007).
Hynes et al., "ERBB Receptors and Cancer: the Complexity of Targeted Inhibitors," Nature Reviews, vol. 5, pp. 341-356 (2005).
Chimu Ra et al., "Expression of c-mel/HGF Receptor in Human Non-small Cell Lung Carcinomas in vitro and in vivo and Its Prognostic Significance," Japan Journal of Cancer Research, vol. 87. pp. 1063-1069 (1996).
Jänne et al., "Effect of Epidermal Growth Factor Receptor Tyrosine Kinase Domain Mutations on the Outcome of Patients with Non-small Cell Lung Cancer Treated with Epidermal Growth Factor Receptor Tyrosine Kinase Inhibitors," Clinical Cancer Research, vol. 12, No. 14 Suppl, pp. 4416s-4420s (2006).

(56) References Cited

OTHER PUBLICATIONS

Jacobs et al., "FN3 Domain Engineering", Protein Engineering, pp. 145-162, 2012.
Li et al., "Skin toxicities associated with epidermal growth factor receptor inhibitors," Target Oncology, vol. 4, pp. 107-119 (2009).
Linardou et al., "Somatic EGFR mutations and efficacy of tyrosine kinase inhibitors in NSCLC," National Review of :; linical Oncology, vol. 6, pp. 352-366 (2009).
Ma et al., "c-Met: Structure, functions and potential for therapeutic inhibition," Cancer and Metastasis Reviews, vol. 22 pp. 309-325 (2003).
Mendelsohn et al., "Epidermal Growth Factor Receptor Targeting in Cancer," Seminars in Oncology, vol. 33, pp. 369-385 (2006).
Mendelsohn et al., "The EGF receptor family as targets for cancer therapy," Oncogene, vol. 19, pp. 6550-6565 2000).
Määttä et al., "Proteolytic Cleavage and Phosphorylation of a Tumor-associated ErbB4 Isoform Promote Ligand-ndependent Survival and Cancer Cell Growth," Molecular Biology, vol. 17, pp. 67-79 (2006).
NCBI Reference Sequence NP _005219.2, "Epidermal Growth Factor Receptor Isoform a Precursor [Homo sapiens]," pp. 1-14 (May 18, 2014).
Panek et al., "In Vitro Pharmacological Characterization of PD 166285, a New Nanomolar Potent and Broadly Active Protein Tyrosine Kinase Inhibitor," The Journal of Pharmacology and Experimental Therapeutics, vol. 283, No. 3, pp. 1433-1444 (1997).
Peters et al., "MET: a promising anticancer therapeutic target," Nature Reviews Clinical Oncology, vol. 9, pp. 314-326 (2012).
Prewett et al., "Mouse-Human chimeric Anti-Epidermal Growth Factor Receptor Antibody C225 Inhibits the Growth Jf Human Renal Cell Carcinoma Xenografts in Nude Mice," Clinical Cancer Research, vol. 4, pp. 2957-2966 (1998).
Riel Yet al., "Clinical Course of Patients with Non-Small Cell Lung Cancer and Epidermal Growth Factor Receptor Exon 19 and Exon 21 Mutations Treated with Gefitinib or Erlotinib," Clinical Cancer Research, vol. 12, No. 3, pp. g39-g844 (2006).
Sakakura et al., "Gains, Losses, and Amplifications of Genomic Materials in Primary Gastric Cancers Analyzed by :; omparative Genomic Hybridization," Genes, Chromosomes & Cancer, vol. 24, pp. 299-305 (1999).
Schmidt et al., "Novel mutations of the MET proto-0ncogene in papillary rental carcinomas," Oncogene, vol. 18, pp. ]343-]2350 (1999).
Siegfried et al., "The Clinical Significance of Hepatocyte Growth Factor for Non-Small Cell Lung Cancer," Annals of Thoracic Surgery, vol. 66, pp. 1915-1918 (1998).
Sierra et al., "c-MET as a potential therapeutic target and biomarker in cancer," Therapeutic Advances in Medical :: >ncology, vol. 3, No. 51, pp. 521-535 (2011).
Stamos et al., "Crystal structure of the HGF b-chain in complex with the Serna domain of the Met receptor," The EMBO Journal, vol. 23, pp. 2325-2335 (2004).
Mamluk et al., "Anti-tumor effect of CT-322 as an Adnectin inhibitor of vascular endothelial growth factor receptor-2", mAbs, 2(2), pp. 199-208, 2010.
Klein et al. "Abstract LB-312: Bispecific Centyrin Simultaneously targeting EGFR and c--Met demonstrates improved ô €?'ctivity compared to the mixture of single agents", Cancer Research, 73 (8 Supplement), Abstract LB-312, Apr. 2013.
Jacobs et al., "Fusion to a highly stable consensus albumin binding domain allows for tunable pharmacokinetics", Protein Engineering, Design & Selection, vol. 28, No. 10, pp. 385-393, 2015.
Notice of Allowance mailed Mar. 3, 2020 in U.S. Appl. No. 15/840,303.
Makkouk Amani et al: "Rationale for anti-CD137 cancer immunotherapy", European Journal of Cancer, Elsevier, Amsterdam, NL, vol. 54, Jan. 2, 2016 (Jan. 2, 2016), pp. 112-119, XP029401784, ISSN: 0959-8049, DOI: 10.1016/j.ejca.2015.09.026 *abstract p. 114, right-hand column, paragraph 4-p. 116, right-hand column, paragraph 1 table 1*.

Shalom D. Goldberg et al: "Engineering a targeted delivery platform using Centyrins", Protein Engineering, Design and Selection, Oct. 13, 2016 (Oct. 13, 2016), XP055384705, GB ISSN: 1741-0126, DOI: 10.1093/protein/gzw054 *abstract p. 564, left-hand column, paragraph 2-right-hand column, line 3 p. 567, right-hand column, paragraph 2 p. 568, right-hand column, paragraph 2-p. 569, left-hand column, paragraph 2table I**figure 1a*.
Burton Earle Barnett et al: "Disclosures", Blood, vol. 128, No. 22, Dec. 2, 2016 (Dec. 2, 2016), pp. 4557-4557, XP055711182, US ISSN: 0006-4971, doi: 10.1182/blood.V128.22.4557.4557 *abstract*.
Final Office Action mailed on Jul. 10, 2020 in U.S. Appl. No. 15/637,276.
Zucali, et al., "Role of cMET expression in non-small-cell lung cancer patients treated with eGFR tyrosine kinase inhibitors", Annals of Anocology (2008) 19:: 1605-1612.
Burgess et al., "Possible dissociation of the heparin-binding and mitogenic activities of heparin-binding (acidic fibroblast) growth factor-1 from its receptor-binding activities by site-directed mutagenesis of a single lysine residue" J Cell Biol (1990) 111: pp. 2129-2138.
Lazar et al., "Transforming growth factor alpha: mutation of aspartic acid 47 and leucie 48 results in different biological activities", Mol Cell Biol. (1988) 8: pp. 1247-1252.
Brown et al., "Tolerance of single, but not multiple, amino acid replacements in antibody VH CDR 2: a means of minimizing B cell wastage from somatic hypermutation", J. Immuno. (1996) pp. 3285-3291.
Rudikoff el al., "Single amino acid substitution altering antigen-binding specificity", Proc Natl Acad Sci (1982) 79(6): pp. 1979-1983.
Vajdos et al., "Comprehensive funtional maps of the antigen-binding site of an anti-ErbB2 antibody obtained with shotgun scanning mutagenisis", J. Mol. Biol. (2002) 32(2): pp. 415-428.
Non-Final Office Action mailed on Jul. 9, 2021 in 16/821,064.
Rybalov et al., "PSMA, EpCAM, VEGF and GRPR as Imaging Targets in Locally Recurrent Prostate Cancer after Radiotherapy", Int. J. Mol. Sci. (2014) 15, pp. 6046-6061.
Non-Final Office Action mailed on Feb. 3, 2021 in U.S. Appl. No. 16/218,990.
Final Office Action mailed on Jul. 21, 2020 in U.S. Appl. No. 16/218,990.
Lejon et al., "Structural basis for the binding of naproxen to human serum albumin in the presence of fatty acids and the GA module", Acta Cryst. (2008) F pp. 64-69.
Lee et al., "A Glu-ruea-Lys Ligand-conjugated Lipid nanoparticle/siRNA System Inhibits Androgen Receptor Expression In Vivo", Molecular Therapy-Nucleic Acids (2016) 5, e348: pp. 1-11.
Pace, "Determination and Analysis of Urea and Guanidine Hydrochloride Denaturation Curves", Methods in Enzymology (1986) vol. 131, pp. 266-280.
Chen et al., "Cell-Surface Display of Heterologous Proteins: From High-Throughput Screening to Environmental Applications", Biotechnology and Bioengineering, (2002) vol. 79, No. 5, pp. 496-503.
Mattheakis et al., "An in vitro polysome display system for identifying ligands from very large peptide libraries", Proc. Natl. Acad. Sci. (1994) Vo.. 91, pp. 9022-9026.
Hoogenboom et al., "Natural and designer binding sites made by phage display technology" Immunology Today (2000) vol. 21, No. 8, pp. 371-378.
Smith, "Filamentous fusion phage: novel expression vectors that display cloned antigens on the virion surface.", Association of Science (1985) vol. 228, pp. 1315(3).
Capellas, "Enzymatic Condensation of Cholecystokinin CCK-8 (4-6) and CCK-8 (7-8) Peptide Fragments in Organic Media", Biotechnology and Bioengineering (1997) vol. 56, No. 4, pp. 456-463.
Yuyu Tan et al., "Selection of Transferrin Receptor-Specific Peptide for Recognition of Cancer Cell," China Science and Technology Papers Online, Apr. 30, 2017, pp. 1-10.
International Search Report and Written Opinion dated Oct. 7, 2022 from International Application No. PCT/US22/24773, International Filing Date Apr. 14, 2022.

(56) References Cited

OTHER PUBLICATIONS

Wu, Xiaoqiu, et als, "Elucidation and Structural Modeling of CD71 as a Molecular Target for Cell-Specific Aptamer Binding," J Am Chem Soc , Jul. 10, 2020; 141(27): 10760-10769. doi: 10.1021/jacs.9b0370.

Falvo, Elisabetta et al., "High Activity and Low Toxicity of a Novel CD71-Targetiong Nanotherapeutic Named The-0504 on Preclinical Models of Several Human Aggressive Tumors," Journal of Experimental Clinical Cancer Research, (2021) 40:63; https://doi.org/10.1186/s13046-021-01851-8, pp. 1-14.

Candelaria, Pierre V. , et al, "Antibodies Targeting the Transferrin Receptor 1 (TfR1) as Direct Anti-Cancer Agents," Frontiers in Immunology (www.frontiersin.org), Mar. 2021, vol. 12, Article 607692.

International Preliminary Report on Patentability dated Apr. 19, 2022 from International Application No. PCT/US2020/055470, International Filing Date Oct. 14, 2020.

International Search Report and Written Opinion dated Mar. 29, 2021 from International Application No. PCT/US2020/055470, International Filing Date Oct. 14, 2020.

Notice of Allowance for U.S. Appl. No. 17/070,337 dated May 24, 2023.

International Preliminary Report on Patentability dated Apr. 19, 2022 from International Application No. PCT/US2020/055509, International Filing Date Oct. 14, 2020.

International Search Report and Written Opinion dated Mar. 22, 2021 from International Application No. PCT/US2020/055509, International Filing Date Oct. 14, 2020.

Skerra, et al., "Engineered protein scaffolds for molecular recognition," Journal of Molecular Recognition, 13: 167-187 (2000).

Koide, et al., "The Fibronectin Type III Domain as a Scaffold for Novel Binding Proteins," Journal of Molecular Biology, 284: 1141-1151 (1998).

Karatan, et al., "Molecular Recognition Properties of FN3 Mono bodies that Bind the Src SH3 Domain," Chemistry & Biology, 11: 835-844 (2004).

Parker, et al., "Antibody mimics based on human fibronectin type three domain engineered for thermostability and high-affinity binding to vascular endothelial growth factor receptor two," Protein Engineering, Design & Selection, 18(9): 435-444 (2005).

Siggers et al. Conformational dynamics in loop swap mutants of homologous fibronectin type III domains. Biophys J. Oct. 1, 2007 ;93(7):2447-56.

Skolnick et al. From genes to protein structure and function: novel applications of computational approaches in the genomic era. Trends Biotechnol. 18(1 ):34-9, 2000.

Attwood TK. Genomics. The Babel of bioinformatics. Science. 290(5491 ):471-473, 2000.

Miller et al Ligand binding to proteins: the binding landscape model. Protein Sci. Oct. 1997;6(10):2166-79.

Kuntz. Structure-based strategies for drug design and discovery. Science. 1992 257(5073):1078-1082.

Koivunen et al. Identification of Receptor Ligands with Phage Display Peptide Libraries J Nucl Med; 40:883-888, 1999.

Reiss et al. Inhibition of platelet aggregation by grafting RGD and KGD sequences on the structural scaffold of small disulfide-rich proteins. Platelets 17(3):153-157, 2006.

Helms et al. Destabilizing loop swaps in the CDRs of an immunoglobulin VL domain. Protein Science 4:2073-2081, 1995.

Bass, et al., "Hormone Phage: An Enrichment Method for Variant Proteins with Altered Binding Properties," Proteins: Structure, Function, and Genetics, 8: 309-314 (1990).

Clarke, et al., "Folding and Stability of a Fibronectin Type III Domain of Human Tenascin," Journal of Molecular Biology, 270: 771-778 (1997).

Dehouck, et al., "Fast and accurate predictions of protein stability changes upon mutations using statistical potentials and neural networks: PoPMuSiC-2.0," Bioinformatics, 25(19): 2537-2543 (2009).

Dineen, et al., "The Adnectin CT-322 is a novel VEGF receptor 2 inhibitor that decreases tumor burden in an orthotopic mouse model of pancreatic cancer," BMC Cancer, 8: 352-361 (2008).

Dutta, et al., "High-affinity fragment complementation of a fibronectin type III domain and its application to stability enhancement," Protein Science, 14: 2838-2848 (2005).

Garrard, et al., "Selection of an anti-IGF-1 Fab from a Fab phage library created by mutagenesis of multiple CDR loops," Gene, 128: 103-109 (1993).

Getmanova, et al., "Antagonists to Human and Mouse Vascular Endothelial Growth Factor Receptor 2 Generated by Directed Protein Evolution In Vitro," Chemistry & Biology, 13: 549-556 (2006).

Hackel, et al., "Stability and CDR Composition Biases Enrich Binder Functionality Landscapes," Journal of Molecular Biology, 401: 84-96 (2010).

Tackel, et al., "Picomolar Affinity Fibronectin Domains Engineered Utilizing Loop Length Diversity, Recursive Mutagenesis, and Loop Shuffling," Journal of Molecular Biology, 381: 1238-1252 (2008).

Knappik, et al., "Fully Synthetic Human Combinatorial Antibody Libraries (HuCAL) Based on Modular Consensus Frameworks and CDRs Randomized with Trinucleotides," Journal of Molecular Biology, 296: 57-86 (2002).

Koide, et al., Teaching an Old Scaffold New Tricks: Monobodies Constructed Using Alternative Surfaces of the FN3 Scaffold, Journal of Molecular Biology, 415: 393-405 (2012).

Lipovsek, et al., "Evolution of an Interloop Disulfide Bond in High-Affinity Antibody Mimics Based on Fibronectin Type II Domain and Selected by Yeast Surface Display: Molecular Convergence with Single-Domain Camelid and Shark Antibodies," Journal of Molecular Biology, 368: 1024-1041 (2007).

C.N. Pace, "Determination and Analysis of Urea and Guanidine Hydrochloride Denaturation Curves," Methods in Enzymology, 131: 266-280 (1986).

Steiner, et al., "Efficient Selection of DARPins with Sub-nonomolar Affinities using SRP Phage Display," Journal of Molecular Biology, 382: 1211-1227 (2008).

Xu, et al., "Directed Evolution of High-Affinity Antibody Mimics Using mRNA Display," Chemistry & Biology, 9: 933-942 (2002).

Cota, et al., "Two Proteins with the Same Structure Respond very Differently to Mutation: The Role of Plasticity in Protein Stability", Journal of Molecular Biology, 302, 713-725 (2000).

Hamill et al., "The Effect of Boundary Selection on the Stability and Folding of the Third Fibronectin Type III Domain from Human Tenascin", Biochemistry, 37: 8071-8079 (1998).

Garcia-Ibilcieta, et al., "Simple method for production of randomized human tenth fibronectin domain III libraries for use in combinatorial screening procedures," Bio Technologies, 44: 559-562 (2008).

Van den Burg et al., "Selection of mutations for increased protein stability", Curr. Opin. Biotech. 13:333-337 (2002).

GenBank Accession No. NP_002151.

Slonomics® Technology Website "https://www.morphosys.com/science/drug-development-capabilities/slonomics".

UniProt Accession No. P10039.

SwissProt Accession No. P00533.2, "Epidermal Growth Factor Receptor," pp. 1-49 (Jun. 11, 2014).

Turke et al., "Preexistence and Clonal Selection of MET Amplification in EGFR Mutant NSCLC," Cancer Cell, vol. 17, pp. 77-88 (2010).

Ullrich et al., "Human epidermal growth factor receptor cDNA sequence and aberrant expression of the amplified Jene in A431 epiderrnoid carcinoma cells," Nature, vol. 309, pp. 418-425 (1984).

Zhang et al., "Complete disulfide bond assignment of a recombinant immunoglobulin G4 monoclonal antibody," Analytical Biochemistry, vol. 311, pp. 1-9 (2002).

Adjei et al., "Early Clinical Development of ARQ197, a Selective, Non-ADP-Competitive Inhibitor Targeting MET Tyrosine Kinase for the Treatment of Advanced Cancers," The Oncologist, vol. 16, pp. 788-799 (2011).

Basel GA et al., "Critical Update and Emerging Trends in Epidermal Growth Factor Receptor Targeting in Cancer," Journal of Clinical Oncology, vol. 23, No. 11, pp. 2445-2459 (2005).

(56) References Cited

OTHER PUBLICATIONS

Batley et al., "Inhibition of FGF-1 Receptor Tyrosine Kinase Activity By PD 161570, a New Protein-Tyrosine Kinase nhibitor," Life Sciences, vol. 62, No. 20, pp. 143-150 (1998).
Bean et al., "MET amplification occurs with or without T790M mutations in EGFR mutant lung tumors with acquired esistance to gefilinib or erlotinib," Proceedings of the National Academy of Science, vol. 104, No. 52, pp. 0932-20937 (2007).
Cappuzzo et al., "Epidermal Growth Factor Receptor Gene and Protein and Gefilinib Sensitivity in Non-small-Cell ung Cancer," Journal of the National Cancer Institute, vol. 97, pp. 643-655 (2005).
Christensen et al., "c-Met as a target for human cancer and characterization of inhibitors for therapeutic intervention," Cancer Letters, vol. 225, pp. 1-26 (2005).
Cooper et al., "Molecular cloning of a new transforming gene from a chemically transformed human cell line," Nature, vol. 311, pp. 29-33 (1984).
DeRoock et al., "Effects of KRAS, BRAF, NRAS, and PIK3CA mutations on the efficacy of cetuximab plus chemotherapy in chemotherapy-refractory metastatic colorectal cancer: a retrospective consortium analysis," Lancet Oncology, vol. 11, pp. 753-762 (2010).
Downward et al., "Autophosphorylation sites on the epidermal growth factor receptor," Nature, vol. 311, pp. 183-485 ( 1984).
Engelman et al., "MET Amplification Leads to Gefitinib Resistance in Lung Cancer by Activating ERBB3 Signaling," Science, vol. 316, pp. 1039-1043 (2007).
Ferguson, Kathryn M., "Structure-Based View of Epidermal Growth Factor Receptor Regulation," Annual Review of Biophysics, vol. 37, pp. 535-373 (2008).
GenBank Accession No. NP 001120972.
Alfthan et al., "Properties of a single-chain antibody containing different linker peptides," Protein Engineering, vol. B, No. 7, pp. 725-731 (1995).
Birtalan et al., "The Intrinsic Contributions of Tyrosine, Serine, Glycine and Arginine to the Affinity and Specificity of Antibodies," Journal of Molecular Biology, vol. 377, pp. 1518-1528 (2008).
Bork et al., "Proposed acquisition of an animal protein domain by bacteria," Proceedings of the National Academy of Science, USA, vol. 89, pp. 8990-8994 (1992).
Hallewell et al., "Genetically Engineered Polymers of Human CuZN Superoxide Dismutase," The Journal of Biological Chemistry, vol. 264, No. 9, pp. 5260-5268 (1989).
Hanes et al, "In vitro selection and evolution of functional proteins by using ribosome display," Proceedings of the National Academy of Sciences USA, vol. 94, pp. 4937-4942 (1997).
Jacobs et al., "Design of novel FN3 domains with high stability by a consensus sequence approach," Protein Engineering, Design & Selection, vol. 25, No. 3, pp. 107-117 (2012).
Diem et al., "Selection of high-affinity Centyrin FN3 domains from a simply library diversified at a combination of strand and loop positions." Protein Engin Design (2014) Selection 27(10): 419-429.
Tannock and Hill. The Basic Science of Oncology. 1998. New York: McGraw-Hill;; pp. 357-358.
Song et al. Cancer stem cells—an old idea that's new again: implications for the diagnosis and treatment of breast cancer. Expert Opin Biol Ther 7:4):431-438, 2007.
Binz et al., "High-affinity binders selected from designed ankyrin repeat protein libraries," Nature Biotechnology, vol. e2, No. 5, pp. 575-582 (May 2004).
Garon et al., "Pembrolizumab for the Treatment of Non-Small-Cell Lung Cancer," The New England Journal of Medicine, vol. 372, No. 21, pp. 2018-2028 (May 21, 2015).
Koide et al., "High-affinity single-domain binding proteins with a binary-code interface," PNAS, vol. 104, No. 16, pp. 6632-6637 (Apr. 17, 2017).
Lepenies et al., "The Role of Negative Costimulators Dunng Parasitic Infections," Endocrine, Metabolic & Immune Disorders—Drug Targets, vol. 8, pp. 279-288 (2008).

McLaughlin et al., "Quantitative Assessment of the Heterogeneity of PD-L 1 Expression in Non-small Cell Lung Cancer (NSCLC)," JAMA Oncol., vol. 2, No. 1, pp. 46-54, (Jan. 2016).
Meinke et al., "Cellulose-Binding Polypeptides from Cellulomonas fimi: Endoglucanase D (CenD), a Family A b-1,4-Glucanase," Journal of Bactenology, vol. 175, No. 7, pp. 1910-1918 (1993).
Odegrip et al., "CIS display: In vitro selection of peptides from libraries of protein-DNA complexes," Proceedings of he National Academy of Science USA, vol. 101, No. 9, pp. 2806-2810 (2004).
Olson et al., "Design, expression, and stability of a diverse protein library based on the human fibronectin type III ô €,?omain," Protein Science, vol. 16, pp. 476-484 (2007).
Roberts et al., "RNA-peptide fusions for the in vitro selection of peptides and proteins," Proceedings of the National Academy of Science USA, vol. 94, pp. 12297-12302 (1997).
Robinson et al., "Covalent Attachment of Arc Repressor Subunits by a Peptide Linker Enhances Affinity for Operator DNA," Biochemistry, vol. 35, pp. 109-116 (1996).
Strohl, William R., "Optimization of Fe-mediated effector functions of monoclonal antibodies," Current Opinion in Biotechnology, vol. 20, pp. 685-691 (2009).
Tie et al., "Safety and efficacy of nivolumab in the treatment of cancers: A meta-analysis of 27 prospective clinical rials," International Journal of Cancer, vol. 140, pp. 948-958, (2017).
Wang et al., "VISTA, a novel mouse lg superfamily ligand that negatively regulates T cell responses," Journal of Experimental Medicine, vol. 208, No. 3, pp. 577-592 (Mar. 14, 2011).
Watanabe et al., "Gene Cloning of Chitinase A1 from Bacillus circulans WL-12 Revealed Its Evolutionary Relationship to Serratia Chitinase and to the Type III Homology Units of Fibronectin," Journal of Biological Chemistry, vol. 265, pp. 15659-15665 (1990).
Cooper et al., "4-1 BB (CD 137) controls the clonal expansion and survival of COB T cells in vivo but does not t: ontribute the development of cytotoxicity", Eur. J_ Immunol., vol. 32, pp. 521-529, 2002.
Gramaglia et al., "Co-stimulation of antigen-specific CD4 T cells by 4-1BB ligand," Eur. J. Immunol., vol. 30, pp. ô €?"92-402 (2000).
DeBenedette et al., "Role of 4-1BB Ligand in Costimulation of T Lymphocyte Growth and its Upregulation on M12 B rymphomas by cAMP," J_ Exp_ Med., vol. 181, pp. 985-992 (1995).
Langstein et al., "CD137 Induces Proliferation and Endomitosis in Monocytes," Blood, vol. 94, No. 9, pp. 3161-3168 1999).
Langstein et al., "CD137 (ILA/4-1 BB), a Member of the TNF Receptor Family, Induces Monocyte Activation via Bidirectional Signaling," The Journal of Immunology, vol. 160, pp. 2488-2494 (1998).
Lee et al., "4-1BB Promotes the Survival of COB+ T Lymphocytes by Increasing Expression of Bcl-xL and Bfl-11," The Journal of Immunol., vol. 169, pp. 4882-4888 (2002).
Michel et al., "A soluble form of CD137 (ILA/4-1BB), a member of the TNF receptor family, is released by activated ymphocytes and is detectable in sera of patients with rheumatoid arthritis," Eur. J_ Immunol., vol. 28, pp. 290-295 1998).
Michel et al., "CD137-induced apoptosis is independent of CD95," Immunology, vol. 98, pp. 42-46 (1999).
Schwarz et al., "ILA, a Member of the Human Nerve Growth FactorfTumor Necrosis Factor Receptor Family, Regulates T-Lymphocyte Proliferation and Survival," Blood, vol. 87, No. 7, pp. 2839-2845 (Apr. 1, 1996).
Shuford et al., "4-18B Costimulatory Signals Preferentially Induce COB+ T Cell Proliferation and Lead to the amplification In Vivo of Cytotoxic T Cell Responses," J_ Exp_ Med., vol. 186, No. 1, pp. 47-55 (Jul. 7, 1997).
Takahashi et al., "Cutting Edge: 4-1 BB Is a Bona Fide Cob T Cell Survival Signal," J Immunol., vol. 162, pp. 0037-5040 (1999).
Alderson et al., "Molecular and Biological Characterization of Human 4-1 BB and its Ligand", Eur. J_ Immunol., vol. N, pp. 2219-2227, 1994.
Hurtado et al., "Potential role of 4-1 BB in T cell Activation Comparison with the Costimulatory Molecule CD28", Journal of Immunology, vol. 155, pp. 3360-3367, 1995.

(56) References Cited

OTHER PUBLICATIONS

Hurtado et al., "Signals through 4-1BB are Costimulatory to previously activated splenic T cells and inhibit activation-induced cell death", Journal of Immunology, vol. 158, pp. 2600-2609, 1997.

Maus et al., Ex vivo expansion of polyclonal and antigen-specific cytotoxic T lymphocytes by artificial APCs Expressing ligands for the T-cell receptor, CD28 and 4-1BB Nature Biotechnology, vol. 20, pp. 143-148, Feb. 2002.

Michel et al., "Expression of soluble CD137 correlates with activation-induced cell death of lymphocytes", Cytokine, vol. 12, No. 6, pp. 742-746, 2000.

Zhou et al., Characterization of human homologue of 4-1 BB and its ligand, Immunology Letters, vol. 45, pp. p7-p73, 1995.

Pauly et al., CD137 is expressed by follicular dendritic cells and costimulates B lymphocyte activation in germinal t; enters, Journal of Leukocyte Biology, vol. 72, pp. 35-42, Jul. 2002.

Langstein et al., Identification of CD137 as a potent monocyte survival factor, Journal of Leukocyte Biology, vol. 65, pp. 829-833, Jun. 1999.

Kwon et al., cDNA sequences of two inducible T-cell genes, Proc. Natl. Acad. Sci., vol. 86, pp. 1963-1967, Mar. 1989.

Lehmann et al., Engineering proteins for thermostability the use of sequence alignments versus rational design and directed evolution, Current Opinion in Biotechnology, vol. 12, pp. 371-375 (2001).

Chiba et al., Amyloid Fibril Formation in the Context of Full-length Protein Effects of Praline mutations on the Amyloid fibril formation of b2-Microglobulin, Journal of Biological Chemistry, vol. 278, No. 47, pp. 47016-47024, Nov. 2003.

Goldberg et al., "Engineering a Targeted Delivery Platform using Centyrins" Protein Engineering, Design & selection, vol. 29, No. 12, pp. 563-572, 2016.

Strand et al., "Site-Specific Radioiodination of HER2-Targeting Affibody Molecules using 4-lodophenethylmaleimide Decreases Renal Uptake of Radioactivity"; Chemistry Open, vol. 4, pp. 174-182, 2015.

Hylarides et al., "Preparation and in Vivo Evaluation of an N-9p-[125I]1odophenethyl)maleimide—Antibody Conjugate" Bioconjugate Chem., vol. 2, pp. 435-440, 1991.

Lohse et al., Fluorescein-Conjugated Lysine monomers for Solid Phase Synthesis of Fluorescent Peptides and PNA Pligomers Bioconjugate Chem, vol. 8, pp. 503-509, 1997 .pdf.

Binz, et al., "Engineered proteins as specific binding reagents," Current Opinion in Biotechnology, 16: 459-469 (2005).

Anderson et al., "Towards next generation antisense oligonucleotides: mesylphosphoramidate modification improves therapeutic index and duration of effect of gapmer antisense oligonucleotides," Nucleic Acids Research, 2021, vol. 49, No. 16, Published online Aug. 20, 2021, https://doi.org/10.1093/nar/gkab718, pp. 9026-9041.

International Search Report and Written Opinion from International Application No. PCT/US2021/030863 dated Oct. 29, 2021, International Filing Date May 5, 2021.

Non-Final Office Action dated Dec. 1, 2022, from U.S. Appl. No. 17/070,337.

Notice of Allowance dated Nov. 28, 2022 in U.S. Appl. No. 17/070,020.

Brewer, et al., Cell Metabolism, "Targeting Pathogenic Lafora Bodies in Lafora Disease Using an Antibody-Enzyme Fusion", CellPress 30, 689-705, Oct. 1, 2019, https://doi.org/10.1016/j.cmet.2019.07.002.

Duran, et al., "Glycogen accumulation underlies neurodegeneration and autophagy impairment in Lafora disease", Human Molecular Genetics, 2014, vol. 23, No. 12 3147-3156 doi:10.1093/hmg/ddu024; Advance Access published on Jan. 22, 2014.

Nitschke, et al., "An inducible glycogen synthase-1 knockout halts but does not reverse Lafora disease progression in mice", https://doi.org/10.1074/jbc.RA120.015773; American Society for Biochemistry and Molecular Biology, J. Biol. Chem. (2021) 296 100150.

Soudah et al., "AntimiR-155 Cyclic Peptide-PNA Conjugate: Synthesis, Cellular Uptake, and Biological Activity", ACS Omega, 2019, 4(9):13954-13961.

Varea, et al., "Suppression of glycogen synthesis as a treatment for Lafora disease: Establishing the window of opportunity", Neurobiology of Disease 147 (2021) 105173, https://doi.org/10.1016/j.nbd.2020.105173!.

Itoh, et al., "Application of Inverse Substrates to Trypsin-Catalyzed Peptide Synthesis", Bioorganic Chemistry (1996) 24, 0007, pp. 59-68.

Kumaran et al., "Confrmationally driven protease-catalyzed splicing of peptide segments: V8 protease-mediated syntheses of fragments derived from thermolysin and ribonuclease A", Protein Science, (1997) 6: pp. 2233-2241.

Kunkel et al., "Rapid and Efficient Site-Specific Mutagenesis without Phenotypic Selection", Methods In Enzymology, (1987) vol. 154 pp. 367-375.

Wattanachaisaereekul, "Production of Polyketides by *Saccharomyces cerevisiae*", Ph.D. Thesis (2007) Center for Microbial Biotechnology, BioCentrum—DTU Technical University of Denmark, pp. 1-187.

Hackel et al., "Use of 64Cu-Labeled Fibronectin Domain with EGFR-Overexpressing Tumor Xenograft: Molecular Imaging1", Radiology (2012) vol. 263: No. 1 pp. 179-188.

Non-Final Office Action mailed on Aug. 18, 2021 in U.S. Appl. No. 16/801,787.

McCracken, "Non-invasive monitoring of hematopoietic reconstitution and immune cell function through Positron Emission Tomography" University of California, Los Angeles, Dissertaton ProQuest LLC (2014) pp. 1-202.

Natarajan, et al., "A Novel Engineered Anti-CD20 Tracer Enables Early Time PET Imaging in a Humanized Transgenic Mouse Model of B-cell Non-Hodgkins Lymphoma", Clin Cancer Res (2013) 19: pp. 6820-6829.

Non-Final Office Action mailed on 24-Sep. 2021 in U.S. Appl. No. 16/820,844.

Non-Final Office Action mailed on Feb. 4, 2022 in U.S. Appl. No. 16/801,787.

Non-Final Office Action dated Feb. 10, 2022 in U.S. Appl. No. 16/218,990.

Olson, William C. et al, "Antibody-drug Conjugates Targeing Prostate-Specific Membrane Antigen," Frontiers in Bioscience (Landmark Edition) 19: pp. 12-33, Jan. 1, 2014.

Tang et al, "Anti-Transferrin Receptor-Modified Amphotericin B-Loaded PLA-PEG Nanoparticles Cure Candidal Meningitis and Reduce Durg Toxicity," Oct. 5, 2015, International Journal of Medicine, 2015:10, pp. 6227-6241.

International Search Report and Written Opinion from PCT/US2022/024846 dated Sep. 12, 2022.

Non-Final Office Action mailed on Aug. 30, 2023 in U.S. Appl. No. 17/720,422 (10 pages).

Non-Final Office Action mailed on Oct. 18, 2023 in U.S. Appl. No. 17/720,996, 23 pages.

\* cited by examiner

FN3 DOMAIN-siRNA CONJUGATES AND USES THEREOF

RELATED APPLICATIONS

The present application claims priority to U.S. Provisional Patent Application No. 63/174,776, filed Apr. 14, 2021, U.S. Provisional Patent Application No. 63/203,776, filed Jul. 30, 2021, and U.S. Provisional Application No. 63/324,437, filed Mar. 28, 2022, which are hereby incorporated by reference in their entirety.

SEQUENCE LISTING

The instant application contains a Sequence Listing which has been submitted electronically in ASCII format and is hereby incorporated by reference in its entirety. Said ASCII copy, created on Feb. 28, 2024, is named ROO-026US SL.txt and is 815,716 bytes in size.

FIELD

The present embodiments relate to siRNA molecules that can be conjugated fibronectin type III domains (FN3) and methods of making and using the molecules.

BACKGROUND

Therapeutic nucleic acids include, e.g., small interfering RNA (siRNA), micro RNA (miRNA), antisense oligonucleotides, ribozymes, plasmids, immune stimulating nucleic acids, antisense, antagomir, antimir, microRNA mimic, supermir, U1 adaptor, and aptamer. In the case of siRNA or miRNA, these nucleic acids can down-regulate intracellular levels of specific proteins through a process termed RNA interference (RNAi). The therapeutic applications of RNAi are extremely broad, since siRNA and miRNA constructs can be synthesized with any nucleotide sequence directed against a target protein. To date, siRNA constructs have shown the ability to specifically down-regulate target proteins in both in vitro and in vivo models. In addition, siRNA constructs are currently being evaluated in clinical studies and have been approved for a variety of diseases.

However, two problems currently faced by siRNA constructs are, first, their susceptibility to nuclease digestion in plasma and, second, their limited ability to gain access to the intracellular compartment where they can bind the RISC (RNA-induced Silencing Complex) when administered systemically as the free siRNA or miRNA. Certain delivery systems, such as lipid nanoparticles formed from cationic lipids with other lipid components, such as cholesterol and PEG lipids, carbohydrates (such as GalNac trimers) have been used to facilitate the cellular uptake of the oligonucleotides. However, these have not been shown to be successful in efficiently and effectively delivering siRNA to its intended target in tissues other than the liver.

There remains a need for compositions and methods for delivering siRNA to its intended cellular target. Further, what is needed is a FN3 domain with optimized properties for clinical use that can specifically bind to CD71, and methods of using such molecules for novel therapeutics that enable intracellular access via receptor mediated internalization of CD71. The present embodiments fulfills these needs as well as others.

SUMMARY

In some embodiments, siRNA conjugated to FN3 domains that bind CD71 protein are provided.

In some embodiments, FN3 domains are provided that comprise the amino acid sequence of any FN3 domain provided herein. In some embodiments, the FN3 domains bind to CD71. In some embodiments, the FN3 domains specifically bind to CD71.

In some embodiments, the composition comprises two FN3 domains connected by a linker, such as a flexible linker. In some embodiments, the two FN3 domains bind to different targets. In some embodiments, a first FN3 domain binds to CD71. In some embodiments, a second FN3 domain binds to a different target that is not CD71.

In some embodiments, oligonucleotides, such as dsRNA or siRNA molecules are provided herein. In some embodiments, the oligonucleotides have the sequences as provided herein, with or without the modifications provided herein. In some embodiments, the oligonucleotides are provided in a composition, such as a pharmaceutical composition. In some embodiments, the oligonucleotides are conjugated to a polypeptide.

In some embodiments, composition comprising one or more FN3 domains conjugated to a siRNA molecule are provided.

In some embodiments, a composition having a formula of $(X1)_n$-$(X2)_q$-$(X3)_y$-L-X4, wherein X1 is a first FN3 domain; X2 is second FN3 domain; X3 is a third FN3 domain or half-life extender molecule; L is a linker; and X4 is an oligonucleotide molecule, wherein n, q, and y are each independently 0 or 1, are provided.

In some embodiments, a composition having a formula of C-$(X1)_n$-$(X2)_q$-$(X3)_y$-L-X4, wherein C is a polymer or albumin binding domain (ABD); X1 is a first FN3 domain; X2 is second FN3 domain; X3 is a third FN3 domain or half-life extender molecule; L is a linker; and X4 is an oligonucleotide molecule, wherein n, q, and y are each independently 0 or 1, are provided.

In some embodiments, a composition having a formula of $(X1)_n$-$(X2)_q$-$(X3)_y$-L-X4-C, wherein X1 is a first FN3 domain; X2 is second FN3 domain; X3 is a third FN3 domain or half-life extender molecule; L is a linker; X4 is an oligonucleotide molecule; and C is a polymer or albumin binding domain (ABD), wherein n, q, and y are each independently 0 or 1, are provided.

In some embodiments, a composition having a formula of X4-L-$(X1)_n$-$(X2)_q$-$(X3)_y$, wherein X1 is a first FN3 domain; X2 is second FN3 domain; X3 is a third FN3 domain or half-life extender molecule; L is a linker; and X4 is an oligonucleotide molecule, wherein n, q, and y are each independently 0 or 1, are provided.

In some embodiments, a composition having a formula of C-X4-L-$(X1)_n$-$(X2)_q$-$(X3)_y$, wherein C is a polymer or albumin binding domain (ABD); X1 is a first FN3 domain; X2 is second FN3 domain; X3 is a third FN3 domain or half-life extender molecule; L is a linker; and X4 is an oligonucleotide molecule, wherein n, q, and y are each independently 0 or 1, are provided.

In some embodiments, a composition having a formula of X4-L-$(X1)_n$-$(X2)_q$-$(X3)_y$-C, wherein X1 is a first FN3 domain; X2 is second FN3 domain; X3 is a third FN3 domain or half-life extender molecule; L is a linker; X4 is an oligonucleotide molecule; and C is a polymer or albumin binding domain (ABD), wherein n, q, and y are each independently 0 or 1, are provided.

In some embodiments, a composition having a formula of C-$(X1)_n$-$(X2)_q$[L-X4]-$(X3)_y$, wherein X1 is a first FN3 domain; X2 is second FN3 domain; X3 is a third FN3 domain or half-life extender molecule; L is a linker; X4 is an oligonucleotide molecule; and C is a polymer or albumin binding domain (ABD), wherein n, q, and y are each independently 0 or 1, are provided.

In some embodiments, a composition having a formula of $(X1)_n$-$(X2)_q$[L-X4]-$(X3)_y$-C, wherein X1 is a first FN3 domain; X2 is second FN3 domain; X3 is a third FN3 domain or half-life extender molecule; L is a linker; X4 is an oligonucleotide molecule; and C is a polymer or albumin binding domain (ABD), wherein n, q, and y are each independently 0 or 1, are provided.

In some embodiments, pharmaceutical compositions comprising one or more of the compositions provided herein are provided.

In some embodiments, methods of treating Pompe Disease (GSD2, acid alpha-glucosidase (GAA) deficiency) in a subject in need thereof, the method comprising administering a composition provided herein are provided.

In some embodiments, methods of treating glycogen storage disease in a subject in need thereof, the method comprising administering a composition provided herein are provided. In some embodiments, the glycogen storage disease is selected from the group consisting of Cori's disease or Forbes' disease (GSD3, Glycogen debranching enzyme (AGL) deficiency), McArdle disease (GSD5, Muscle glycogen phosphorylase (PYGM) deficiency), type II Diabetes/diabetic nephropathy, Aldolase A Deficiency GSD12, Lafora Disease, hypoxia, Andersen disease (GSD4, Glycogen debranching enzyme (GBE1) deficiency), Tarui's Disease (GSD7, Muscle phosphofructokinase (PFKM) deficiency), and adult polyglucosan body disease. In some embodiments, the glycogen storage disease is selected from the group consisting of Glycogen synthase (GYS2) deficiency (GSD0), Glucose-6-phosphatase (G6PC/SLC37A4) deficiency (GSD1, von Gierke's disease), Hers' disease (GSD6, Liver glycogen phosphorylase (PYGL) or Muscle phosphoglycerate mutase (PGAM2) deficiency), Phosphorylase kinase (PHKA2/PHKB/PHKG2/PHKA1) deficiency (GSD9), Phosphoglycerate mutase (PGAM2) deficiency (GSD10), Muscle lactate dehydrogenase (LDHA) deficiency (GSD11), Fanconi-Bickel syndrome (GSD 11, Glucose transporter (GLUT2) deficiency, Aldolase A deficiency (GSD 12), β-enolase (ENO3) deficiency (GSD13), and Glycogenin-1 (GYG1) deficiency (GSD15).

In some embodiments, methods of treating cancer in a subject in need thereof, the method comprising administering to the subject a composition provided herein are provided.

In some embodiments, methods of treating a neurological condition and/or a brain tumor in a subject in need thereof, the method comprising administering to the subject a composition provided herein are provided. In some embodiments, the neurological condition is selected from the group consisting of Alzheimer's Disease, Amyotrophic Lateral Sclerosis, Parkinson's Disease, Lafora Disease, Pompe Disease, adult polyglucosan body disease, stroke, spinal cord injury, ataxia, Bell's Palsy, cerebral aneurysm, epilepsy, seizures, Guillain-Barre Syndrome, multiple sclerosis, muscular dystrophy, neurocutaneous syndromes, migraine, encephalitis, septicemia, and myasthenia gravis.

In some embodiments, methods of treating an autoimmune disease in a subject in need thereof, the method comprising administering to the subject a composition provided herein are provided. In some embodiments, the autoimmune disease is selected from the group consisting of rheumatoid arthritis, Hashimoto's autoimmune thyroiditis, celiac disease, diabetes mellitus type 1, vitiligo, rheumatic fever, pernicious anemia/atrophic gastritis, alopecia areata, and immune thrombocytopenic purpura.

In some embodiments, a use of a composition as provided herein or of any of in the preparation of a pharmaceutical composition or medicament for treating cancer are provided. In some embodiments, the cancer is selected from the group consisting of acute myeloid leukemia, myelodysplastic syndromes, gastric cancer, clear cell renal cell carcinoma, clear cell carcinomas of the breast, clear cell carcinomas of the endometrium, clear cell carcinomas of the ovary, clear cell carcinomas of the uterus, hepatocellular carcinoma, pancreatic cancer, prostate cancer, soft tissue cancer, Ewings sarcoma, and non-small cell lung cancer In some embodiments, methods of reducing the expression of a target gene in a cell, the method comprising contacting the cell with a composition as provided herein are provided. In some embodiments, the cell is a tumor cell, a liver cell, a muscle cell, an immune cell, a dendritic cell, a heart cell, or a cell of the CNS.

In some embodiments, methods of selectively reducing GYS1 mRNA and protein in skeletal muscle. In certain embodiments, GYS1 mRNA and protein is not reduced in the liver and/or the kidney.

In some embodiments, isolated polynucleotides encoding the FN3 domains described herein are provided.

In some embodiments, a vector comprising the polynucleotides described herein are provided.

In some embodiments, a host cell comprising the vectors described herein are provided.

In some embodiments, methods of producing the FN3 domains are provided. In some embodiments, the method comprises culturing a host cell comprising a vector encoding or expressing the FN3 domain. In some embodiments, the method further comprises purifying the FN3 domain. In some embodiments, the FN3 domain binds CD71.

In some embodiments, pharmaceutical compositions comprising a FN3 domain that binds to CD71 linked to an oligonucleotide molecule and a pharmaceutically acceptable carrier are provided. In some embodiments, kits comprising one or more of the FN3 domains with or without the oligonucleotide molecules are provided.

DETAILED DESCRIPTION OF THE DISCLOSURE

Figure 1:
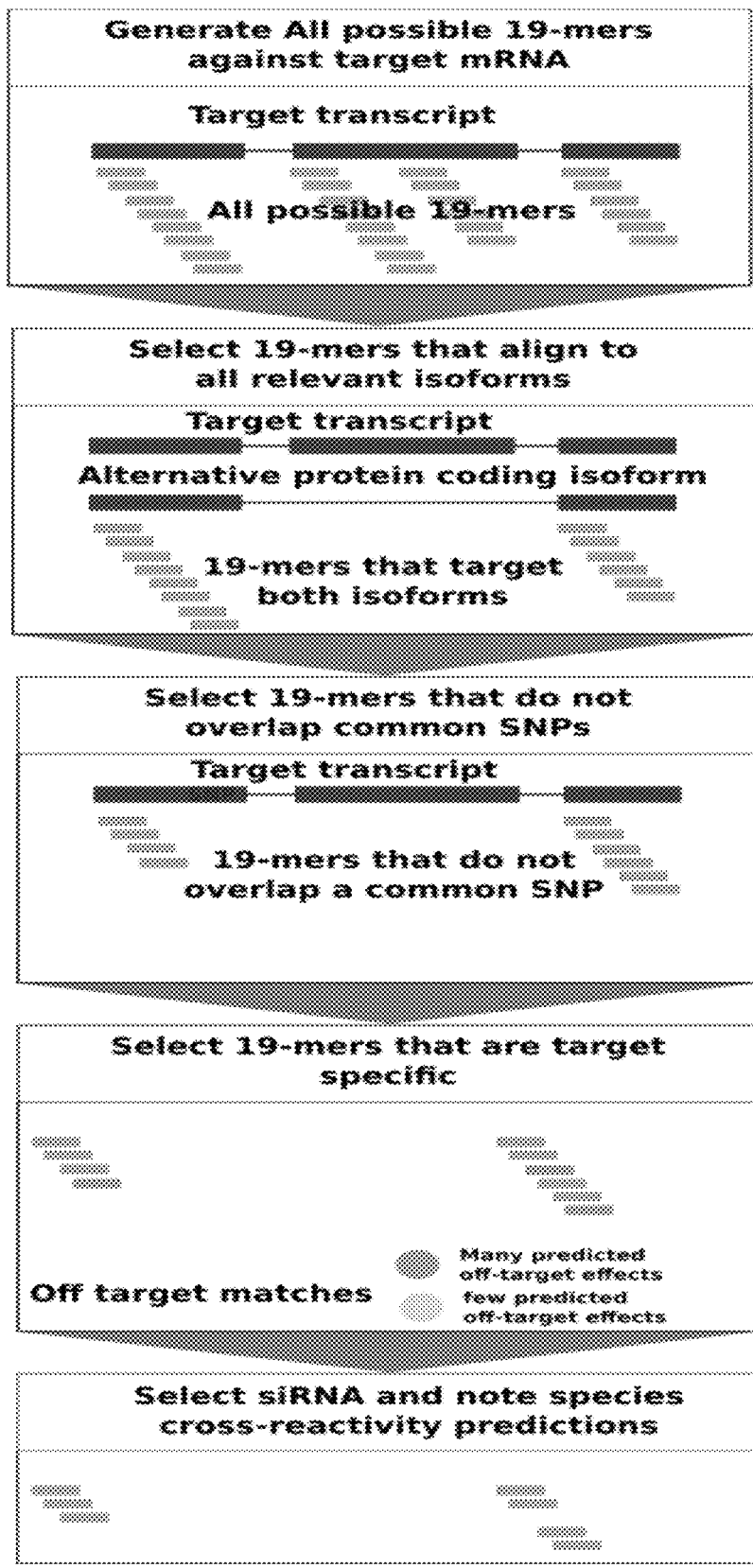
FIG. 1 is a flow chart representing the properties assessed and considered for siRNA screening.

As used in this specification and the appended claims, the singular forms "a," "an," and "the" include plural referents unless the content clearly dictates otherwise. Thus, for example, reference to "a cell" includes a combination of two or more cells, and the like.

"Fibronectin type III (FN3) domain" (FN3 domain) refers to a domain occurring frequently in proteins including fibronectins, tenascin, intracellular cytoskeletal proteins, cytokine receptors and prokaryotic enzymes (Bork and Doolittle, Proc Nat Acad Sci USA 89:8990-8994, 1992; Meinke et al., J Bacteriol 175:1910-1918, 1993; Watanabe et al., J Biol Chem 265:15659-15665, 1990). Exemplary FN3 domains are the 15 different FN3 domains present in human tenascin C, the 15 different FN3 domains present in human fibronectin (FN), and non-natural synthetic FN3 domains as described for example in U.S. Pat. No. 8,278,419. Individual FN3 domains are referred to by domain number and protein name, e.g., the $3^{rd}$ FN3 domain of tenascin (TN3), or the 10th FN3 domain of fibronectin (FN10). As used throughout, "centyrin" also refers to a FN3 domain. Further, FN3 domains as described herein are not antibodies as they do not have the structure of a variable heavy ($V_H$) and/or light ($V_L$) chain.

As used herein, "autoimmune disease" refers to disease conditions and states wherein the immune response of an individual is directed against the individual's own constituents, resulting in an undesirable and often debilitating condition. As used herein, "autoimmune disease" is intended to further include autoimmune conditions, syndromes, and the like. Autoimmune diseases include, but are not limited to, Addison's disease, allergy, allergic rhinitis, ankylosing spondylitis, asthma, atherosclerosis, autoimmune diseases of the ear, autoimmune diseases of the eye, autoimmune atrophic gastritis, autoimmune hepatitis, autoimmune hymolytic anemia, autoimmune parotitis, autoimmune uveitis, celiac disease, primary biliary cirrhosis, benign lymphocytic aniitis, COPD, colitis, coronary heart disease, Crohn's disease, diabetes (Type I), depression, diabetes, including Type 1 and/or Type 2 diabetes, epididymitis, glomerulonephritis, Goodpasture's syndrome, Graves' disease, Guillain-Barre syndrome, Hashimoto's disease, hemolytic anemia, idiopathic thrombocytopenic purpura, inflammatory bowel disease (IBD), immune response to recombinant drug products, e.g., factor VII in hemophilia, juvenile idiopathic arthritis, systemic lupus erythematosus, lupus nephritis, male infertility, mixed connective tissue disease, multiple sclerosis, myasthenia gravis, oncology, osteoarthritis, pain, primary myxedema, pemphigus, pernicious anemia, polymyositis, psoriasis, psoriatic arthritis, reactive arthritis, rheumatic fever, rheumatoid arthritis, sarcoidosis, scleroderma, Sjogren's syndrome, spondyloarthropathies, sympathetic ophthalmia, T-cell lymphoma, T-cell acute lymphoblastic leukemia, testicular antiocentric T-cell lymphoma, thyroiditis, transplant rejection, ulcerative colitis, autoimmune uveitis, and vasculitis. Autoimmune diseases include, but are not limited to, conditions in which the tissue affected is the primary target, and in some cases, the secondary target. Such conditions include, but are not limited to, AIDS, atopic allergy, bronchial asthma, eczema, leprosy, schizophrenia, inherited depression, transplantation of tissues and organs, chronic fatigue syndrome, Alzheimer's disease, Parkinson's disease, myocardial infarction, stroke, autism, epilepsy, Arthus's phenomenon, anaphylaxis, and alcohol and drug addiction.

The term "capture agent" refers to substances that bind to a particular type of cells and enable the isolation of that cell from other cells. Exemplary capture agents are magnetic beads, ferrofluids, encapsulating reagents, molecules that bind the particular cell type and the like.

"Sample" refers to a collection of similar fluids, cells, or tissues isolated from a subject, as well as fluids, cells, or tissues present within a subject. Exemplary samples are tissue biopsies, fine needle aspirations, surgically resected tissue, organ cultures, cell cultures and biological fluids such as blood, serum and serosal fluids, plasma, lymph, urine, saliva, cystic fluid, tear drops, feces, sputum, mucosal secretions of the secretory tissues and organs, vaginal secretions, ascites fluids, fluids of the pleural, pericardial, peritoneal, abdominal and other body cavities, fluids collected by bronchial lavage, synovial fluid, liquid solutions contacted with a subject or biological source, for example, cell and organ culture medium including cell or organ conditioned medium and lavage fluids and the like.

"Substituting" or "substituted" or 'mutating" or "mutated" refers to altering, deleting of inserting one or more amino acids or nucleotides in a polypeptide or polynucleotide sequence to generate a variant of that sequence.

"Variant" refers to a polypeptide or a polynucleotide that differs from a reference polypeptide or a reference polynucleotide by one or more modifications for example, substitutions, insertions or deletions.

"Specifically binds" or "specific binding" refers to the ability of a FN3 domain to bind to its target, such as CD71, with a dissociation constant ($K_D$) of about $1\times10^{-6}$M or less, for example about $1\times10^{-7}$M or less, about $1\times10^{-8}$M or less, about $1\times10^{-9}$M or less, about $1\times10^{-10}$ M or less, about $1\times10^{-11}$ M or less, about $1\times10^{-12}$M or less, or about $1\times10^{-13}$M or less. Alternatively, "specific binding" refers to the ability of a FN3 domain to bind to its target (e.g. CD71) at least 5-fold above a negative control in standard solution ELISA assay. Specific binding can also be demonstrated using the proteome array as described herein and shown in FIG. 3. In some embodiments, a negative control is an FN3 domain that does not bind CD71. In some embodiment, an FN3 domain that specifically binds CD71 may have cross-reactivity to other related antigens, for example to the same predetermined antigen from other species (homologs), such as *Macaca fascicularis* (cynomolgous monkey, cyno) or *Pan troglodytes* (chimpanzee).

"Library" refers to a collection of variants. The library may be composed of polypeptide or polynucleotide variants.

"Stability" refers to the ability of a molecule to maintain a folded state under physiological conditions such that it retains at least one of its normal functional activities, for example, binding to a predetermined antigen such as CD71.

"CD71" refers to human CD71 protein having the amino acid sequence of SEQ ID NOs: 2 or 5. In some embodiments, SEQ ID NO: 2 is full length human CD71 protein. In some embodiments, SEQ ID NO: 5 is the extracellular domain of human CD71.

"Tencon" refers to the synthetic fibronectin type III (FN3) domain having the consensus sequence shown in SEQ ID NO:1

LPAPKNLVVSEVTEDSLRLSWTAPDAAFDSFLIQYQESEKVGEAINLTVP

GSERSYDLTGLKPGTEYTVSIYGVKGGHRSNPLSAEFTT and described in U.S. Pat. Publ. No. 2010/0216708.

A "cancer cell" or a "tumor cell" refers to a cancerous, pre-cancerous or transformed cell, either in vivo, ex vivo, and in tissue culture, that has spontaneous or induced phenotypic changes that do not necessarily involve the uptake of new genetic material. Although transformation can arise from infection with a transforming virus and incorporation of new genomic nucleic acid, or uptake of exogenous nucleic acid, it can also arise spontaneously or following exposure to a carcinogen, thereby mutating an endogenous gene. Transformation/cancer is exemplified by, e.g., morphological changes, immortalization of cells, aberrant growth control, foci formation, proliferation, malignancy, tumor specific markers levels, invasiveness, tumor growth or suppression in suitable animal hosts such as nude mice, and the like, in vitro, in vivo, and ex vivo (Freshney, Culture of Animal Cells: A Manual of Basic Technique (3rd ed. 1994)).

A "dendritic cell" refers to a type of antigen-presenting cell (APC) that form an important role in the adaptive immune system. The main function of dendritic cells is to present antigens to T lymphocytes, and to secrete cytokines that may further modulate the immune response directly or indirectly. Dendritic cells have the capacity to induce a primary immune response in the inactive or resting naïve T lymphocytes.

An "immune cell" refers to the cells of the immune system categorized as lymphocytes (T-cells, B-cells and NK cells), neutrophils, or monocytes/macrophages. These are all types of white blood cells.

"Vector" refers to a polynucleotide capable of being duplicated within a biological system or that can be moved between such systems. Vector polynucleotides typically contain elements, such as origins of replication, polyadenylation signal or selection markers that function to facilitate the duplication or maintenance of these polynucleotides in a biological system. Examples of such biological systems may include a cell, virus, animal, plant, and reconstituted biological systems utilizing biological components capable of duplicating a vector. The polynucleotide comprising a vector may be DNA or RNA molecules or a hybrid of these.

"Expression vector" refers to a vector that can be utilized in a biological system or in a reconstituted biological system to direct the translation of a polypeptide encoded by a polynucleotide sequence present in the expression vector.

"Polynucleotide" refers to a synthetic molecule comprising a chain of nucleotides covalently linked by a sugar-phosphate backbone or other equivalent covalent chemistry. cDNA is a typical example of a polynucleotide.

"Polypeptide" or "protein" refers to a molecule that comprises at least two amino acid residues linked by a peptide bond to form a polypeptide. Small polypeptides of less than about 50 amino acids may be referred to as "peptides".

"Valent" refers to the presence of a specified number of binding sites specific for an antigen in a molecule. As such, the terms "monovalent", "bivalent", "tetravalent", and "hexavalent" refer to the presence of one, two, four and six binding sites, respectively, specific for an antigen in a molecule.

"Subject" includes any human or nonhuman animal. "Nonhuman animal" includes all vertebrates, e.g., mammals and non-mammals, such as nonhuman primates, sheep, dogs, cats, horses, cows chickens, amphibians, reptiles, etc. Except when noted, the terms "patient" or "subject" are used interchangeably.

"Isolated" refers to a homogenous population of molecules (such as synthetic polynucleotides or a polypeptide such as FN3 domains) which have been substantially separated and/or purified away from other components of the system the molecules are produced in, such as a recombinant cell, as well as a protein that has been subjected to at least one purification or isolation step. "Isolated FN3 domain" refers to an FN3 domain that is substantially free of other cellular material and/or chemicals and encompasses FN3 domains that are isolated to a higher purity, such as to 80%, 81%, 82%, 83%, 84%, 85%, 86%, 87%, 88%, 89%, 90%, 91%, 92%, 93%, 94%, 95%, 96%, 97%, 98%, 99% or 100% purity.

In some embodiments, a composition comprising a polypeptide, such as a polypeptide comprising a FN3 domain, linked to an oligonucleotide molecule are provided. The oligonucleotide molecule can be, for example, a siRNA molecule.

Accordingly, in some embodiments, the siRNA is a double-stranded RNAi (dsRNA) agent capable of inhibiting the expression of a target gene. The dsRNA agent comprises a sense strand (passenger strand) and an antisense strand (guide strand). In some embodiments, each strand of the dsRNA agent can range from 12-40 nucleotides in length. For example, each strand can be from 14-40 nucleotides in length, 17-37 nucleotides in length, 25-37 nucleotides in length, 27-30 nucleotides in length, 17-23 nucleotides in length, 17-21 nucleotides in length, 17-19 nucleotides in length, 19-25 nucleotides in length, 19-23 nucleotides in length, 19-21 nucleotides in length, 21-25 nucleotides in length, or 21-23 nucleotides in length.

In some embodiments, the sense strand and antisense strand typically form a duplex dsRNA. The duplex region of a dsRNA agent may be from 12-40 nucleotide pairs in length. For example, the duplex region can be from 14-40 nucleotide pairs in length, 17-30 nucleotide pairs in length, 25-35 nucleotides in length, 27-35 nucleotide pairs in length, 17-23 nucleotide pairs in length, 17-21 nucleotide pairs in length, 17-19 nucleotide pairs in length, 19-25 nucleotide pairs in length, 19-23 nucleotide pairs in length, 19-21 nucleotide pairs in length, 21-25 nucleotide pairs in length, or 21-23 nucleotide pairs in length. In another example, the duplex region is selected from 15, 16, 17, 18, 19, 20, 21, 22, 23, 24, 25, 26, and 27 nucleotide pairs in length.

In some embodiments, the dsRNA comprises one or more overhang regions and/or capping groups of dsRNA agent at the 3'-end, or 5'-end or both ends of a strand. The overhang can be 1-10 nucleotides in length, 1-6 nucleotides in length, for instance 2-6 nucleotides in length, 1-5 nucleotides in length, 2-5 nucleotides in length, 1-4 nucleotides in length, 2-4 nucleotides in length, 1-3 nucleotides in length, 2-3 nucleotides in length, or 1-2 nucleotides in length. The overhangs can be the result of one strand being longer than the other, or the result of two strands of the same length being staggered. The overhang can form a mismatch with the target mRNA or it can be complementary to the gene sequences being targeted or can be other sequence. The first and second strands can also be joined, e.g., by additional bases to form a hairpin, or by other non-base linkers.

In some embodiments, the nucleotides in the overhang region of the dsRNA agent can each independently be a modified or unmodified nucleotide including, but not limited to 2'-sugar modified, such as, 2-F, 2'-Omethyl, 2'-O-(2-methoxyethyl), 2'-O-(2-methoxyethyl), 2'-O-(2-methoxyethyl), and any combinations thereof. For example, TT (UU) can be an overhang sequence for either end on either strand. The overhang can form a mismatch with the target mRNA or it can be complementary to the gene sequences being targeted or can be other sequence.

The 5'- or 3'-overhangs at the sense strand, antisense strand or both strands of the dsRNA agent may be phosphorylated. In some embodiments, the overhang region contains two nucleotides having a phosphorothioate, phosphorodithioate, phosphonate, phosphoramidate, or mesyl phosphoramidate between the two nucleotides, where the two nucleotides can be the same or different. In one embodiment, the overhang is present at the 3'-end of the sense strand, antisense strand or both strands. In one embodiment, this 3'-overhang is present in the antisense strand. In one embodiment, this 3'-overhang is present in the sense strand.

The dsRNA agent may comprise only a single overhang, which can strengthen the interference activity of the dsRNA, without affecting its overall stability. For example, the single-stranded overhang is located at the 3'-terminal end of the sense strand or, alternatively, at the 3'-terminal end of the antisense strand. The dsRNA may also have a blunt end, located at the 5'-end of the antisense strand (or the 3'-end of the sense strand) or vice versa. Generally, the antisense strand of the dsRNA has a nucleotide overhang at the 3'-end, and the 5'-end is blunt. While not bound by theory, the asymmetric blunt end at the 5'-end of the antisense strand and 3'-end overhang of the antisense strand favor the guide strand loading into RISC. For example the single overhang comprises at least two, three, four, five, six, seven, eight, nine, or ten nucleotides in length.

In some embodiments, the dsRNA agent may also have two blunt ends, at both ends of the dsRNA duplex.

In some embodiments, every nucleotide in the sense strand and antisense strand of the dsRNA agent may be modified. Each nucleotide may be modified with the same or different modification which can include one or more alteration of one or both of the non-linking phosphate oxygens and/or of one or more of the linking phosphate oxygens; alteration of a constituent of the ribose sugar, e.g., of the 2 hydroxyl on the ribose sugar; wholesale replacement of the phosphate moiety with "dephospho" linkers; modification or replacement of a naturally occurring base; and replacement or modification of the ribose-phosphate backbone.

In some embodiments all or some of the bases in a 3' or 5' overhang may be modified, e.g., with a modification described herein. Modifications can include, e.g., the use of modifications at the 2' position of the ribose sugar with modifications that are known in the art, e.g., the use of deoxyribonucleotides, 2'-deoxy-2'-fluoro (2'-F) or 2'-O-methyl modified instead of the ribosugar of the nucleobase, and modifications in the phosphate group, e.g., phosphorothioate, phosphorodithioate, phosphonate, phosphoramidate, or mesyl phosphoramidate modifications. Overhangs need not be homologous with the target sequence.

In some embodiments, each residue of the sense strand and antisense strand is independently modified with LNA, HNA, CeNA, 2'-methoxyethyl, 2'-O-methyl, 2'-O-allyl, 2'-C-allyl, 2'-deoxy, or 2'-fluoro. The strands can contain more than one modification. In one embodiment, each residue of the sense strand and antisense strand is independently modified with 2'-O-methyl or 2'-fluoro.

In some embodiments, at least two different modifications are typically present on the sense strand and antisense strand. Those two modifications may be the 2'-deoxy, 2'-O-methyl or 2'-fluoro modifications, acyclic nucleotides or others.

In one embodiment, the sense strand and antisense strand each comprises two differently modified nucleotides selected from 2'-fluoro, 2'-O-methyl or 2'-deoxy.

The dsRNA agent may further comprise at least one phosphorothioate, phosphorodithioate, phosphonate, phosphoramidate, mesyl phosphoramidate, or methylphosphonate internucleotide linkage. The phosphorothioate, phosphorodithioate, phosphonate, phosphoramidate, mesyl phosphoramidate, or methylphosphonate internucleotide linkage modification may occur on any nucleotide of the sense strand or antisense strand or both in any position of the strand. For instance, the internucleotide linkage modification may occur on every nucleotide on the sense strand and/or antisense strand; each internucleotide linkage modification may occur in an alternating pattern on the sense strand or antisense strand; or the sense strand or antisense strand comprises both internucleotide linkage modifications in an alternating pattern. The alternating pattern of the internucleotide linkage modification on the sense strand may be the same or different from the antisense strand, and the alternating pattern of the internucleotide linkage modification on the sense strand may have a shift relative to the alternating pattern of the internucleotide linkage modification on the antisense strand.

In some embodiments, the dsRNA agent comprises the phosphorothioate, phosphorodithioate, phosphonate, phosphoramidate, mesyl phosphoramidate, or methylphosphonate internucleotide linkage modification in the overhang region. For example, the overhang region comprises two nucleotides having a phosphorothioate, phosphorodithioate, phosphonate, phosphoramidate, mesyl phosphoramidate, or methylphosphonate internucleotide linkage between the two nucleotides. Internucleotide linkage modifications also may be made to link the overhang nucleotides with the terminal paired nucleotides within duplex region. For example, at least 2, 3, 4, or all the overhang nucleotides may be linked through phosphorothioate, phosphorodithioate, phosphonate, phosphoramidate, mesyl phosphoramidate, or methylphosphonate internucleotide linkage, and optionally, there may be additional phosphorothioate, phosphorodithioate, phosphonate, phosphoramidate, mesyl phosphoramidate, or methylphosphonate internucleotide linkages linking the overhang nucleotide with a paired nucleotide that is next to the overhang nucleotide. For instance, there may be at least two phosphorothioate internucleotide linkages between the terminal three nucleotides, in which two of the three nucleotides are overhang nucleotides, and the third is a paired nucleotide next to the overhang nucleotide. In some embodiments, these terminal three nucleotides may be at the 3'-end of the antisense strand.

In some embodiments, the dsRNA composition is linked by a modified base or nucleoside analogue as described in U.S. Pat. No. 7,427,672, which is incorporated herein by reference. In some embodiments, the modified base or nucleoside analogue is referred to as the linker or L in formulas described herein.

In some embodiments, the modified base or nucleoside analogue has the structure as shown in Chemical Formula I and a salt thereof:

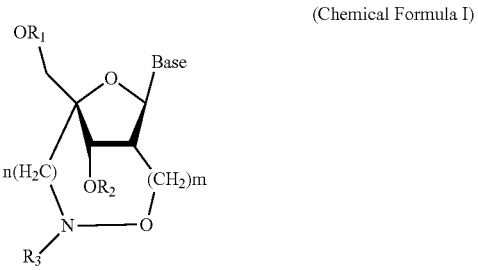
(Chemical Formula I)

where Base represents an aromatic heterocyclic group or aromatic hydrocarbon ring group optionally having a substituent, $R_1$ and $R_2$ are identical or different, and each represent a hydrogen atom, a protective group for a hydroxyl group for nucleic acid synthesis, an alkyl group, an alkenyl group, a cycloalkyl group, an aryl group, an aralkyl group, an acyl group, a sulfonyl group, a silyl group, a phosphate group, a phosphate group protected with a protective group for nucleic acid synthesis, or —P($R_4$)$R_5$ where $R_4$ and $R_5$ are identical or different, and each represent a hydroxyl group, a hydroxyl group protected with a protective group for nucleic acid synthesis, a mercapto group, a mercapto group protected with a protective group for nucleic acid synthesis, an amino group, an alkoxy group having 1 to 5 carbon atoms, an alkylthio group having 1 to 5 carbon atoms, a cyanoalkoxy group having 1 to 6 carbon atoms, or an amino group substituted by an alky group having 1 to 5 carbon atoms, $R_3$ represents a hydrogen atom, an alkyl group, an alkenyl group, a cycloalkyl group, an aryl group, an aralkyl group, an acyl group, a sulfonyl group, or a functional molecule unit substituent, and m denotes an integer of 0 to 2, and n denotes an integer of 0 to 3. In some embodiments, m and n are 0.

In some embodiments, the modified base or nucleoside analogue has the structure as shown in Chemical Formula I and salts thereof, wherein $R_1$ is a hydrogen atom, an aliphatic acyl group, an aromatic acyl group, an aliphatic or aromatic sulfonyl group, a methyl group substituted by one to three aryl groups, a methyl group substituted by one to three aryl groups having an aryl ring substituted by a lower alkyl, lower alkoxy, halogen, or cyano group, or a silyl group.

In some embodiments, the modified base or nucleoside analogue has the structure as shown in Chemical Formula I and salts thereof, wherein $R_1$ is a hydrogen atom, an acetyl group, a benzoyl group, a methanesulfonyl group, a p-toluenesulfonyl group, a benzyl group, a p-methoxybenzyl group, a trityl group, a dimethoxytrityl group, a monomethoxytrityl group, or a tert-butyldiphenylsilyl group.

In some embodiments, the modified base or nucleoside analogue has the structure as shown in Chemical Formula I and salts thereof, wherein $R_2$ is a hydrogen atom, an aliphatic acyl group, an aromatic acyl group, an aliphatic or aromatic sulfonyl group, a methyl group substituted by one to three aryl groups, a methyl group substituted by one to three aryl groups having an aryl ring substituted by a lower alkyl, lower alkoxy, halogen, or cyano group, a silyl group, a phosphoroamidite group, a phosphonyl group, a phosphate group, or a phosphate group protected with a protective group for nucleic acid synthesis.

In some embodiments, the modified base or nucleoside analogue has the structure as shown in Chemical Formula I and salts thereof, wherein $R_2$ is a hydrogen atom, an acetyl group, a benzoyl group, a methanesulfonyl group, a p-toluenesulfonyl group, a benzyl group, a p-methoxybenzyl group, a tert-butyldiphenylsilyl group, —P(OC$_2$H$_4$CN)(N(i-Pr)$_2$), —P(OCH$_3$)(N(i-Pr)$_2$), a phosphonyl group, or a 2-chlorophenyl- or 4-chlorophenylphosphate group.

In some embodiments, the modified base or nucleoside analogue has the structure as shown in Chemical Formula I and salts thereof, wherein $R_3$ is a hydrogen atom, a phenoxyacetyl group, an alkyl group having 1 to 5 carbon atoms, an alkenyl group having 1 to 5 carbon atoms, an aryl group having 6 to 14 carbon atoms, a methyl group substituted by one to three aryl groups, a lower aliphatic or aromatic sulfonyl group such as a methanesulfonyl group or a p-toluenesulfonyl group, an aliphatic acyl group having 1 to 5 carbon atoms such as an acetyl group, or an aromatic acyl group such as a benzoyl group.

In some embodiments, the modified base or nucleoside analogue has the structure as shown in Chemical Formula I and salts thereof, wherein the functional molecule unit substituent as $R_3$ is a fluorescent or chemiluminescent labeling molecule, a nucleic acid incision activity functional group, or an intracellular or nuclear transfer signal peptide.

In some embodiments, the modified base or nucleoside analogue has the structure as shown in Chemical Formula I and salts thereof, wherein Base is a purin-9-yl group, a 2-oxopyrimidin-1-yl group, or a purin-9-yl group or a 2-oxopyrimidin-1-yl group having a substituent selected from the following a group: a group: A hydroxyl group, a hydroxyl group protected with a protective group for nucleic acid synthesis, an alkoxy group having 1 to 5 carbon atoms, a mercapto group, a mercapto group protected with a protective group for nucleic acid synthesis, an alkylthio group having 1 to 5 carbon atoms, an amino group, an amino group protected with a protective group for nucleic acid synthesis, an amino group substituted by an alkyl group having 1 to 5 carbon atoms, an alkyl group having 1 to 5 carbon atoms, and a halogen atom.

In some embodiments, the modified base or nucleoside analogue has the structure as shown in Chemical Formula I and salts thereof, wherein Base is 6-aminopurin-9-yl (i.e., adeninyl), 6-aminopurin-9-yl having the amino group protected with a protective group for nucleic acid synthesis, 2,6-diaminopurin-9-yl, 2-amino-6-chloropurin-9-yl, 2-amino-6-chloropurin-9-yl having the amino group protected with a protective group for nucleic acid synthesis, 2-amino-6-fluoropurin-9-yl, 2-amino-6-fluoropurin-9-yl having the amino group protected with a protective group for nucleic acid synthesis, 2-amino-6-bromopurin-9-yl, 2-amino-6-bromopurin-9-yl having the amino group protected with a protective group for nucleic acid synthesis, 2-amino-6-hydroxypurin-9-yl (i.e., guaninyl), 2-amino-6-hydroxypurin-9-yl having the amino group protected with a protective group for nucleic acid synthesis, 6-amino-2-methoxypurin-9-yl, 6-amino-2-chloropurin-9-yl, 6-amino-2-fluoropurin-9-yl, 2,6-dimethoxypurin-9-yl, 2,6-dichloropurin-9-yl, 6-mercaptopurin-9-yl, 2-oxo-4-amino-1,2-dihydropyrimidin-1-yl (i.e., cytosinyl), 2-oxo-4-amino-1,2-dihydropyrimidin-1-yl having the amino group protected with a protective group for nucleic acid synthesis, 2-oxo-4-amino-5-fluoro-1,2-dihydropyrimidin-1-yl, 2-oxo-4-amino-5-fluoro-1,2-dihydropyrimidin-1-yl having the amino group protected with a protective group for nucleic acid synthesis, 4-amino-2-oxo-5-chloro-1,2-dihydropyrimidin-1-yl, 2-oxo-4-methoxy-1,2-dihydropyrimidin-1-yl, 2-oxo-4-mercapto-1,2-dihydropyrimidin-1-yl, 2-oxo-4-hydroxy-1,2-dihydropyrimidin-1-yl (i.e., uracinyl), 2-oxo-4-hydroxy-5-methyl-1,2-dihydropyrimidin-1-yl (i.e., thyminyl), 4-amino-5-methyl- 2-oxo-1,2-dihydropyrimidin-1-yl (i.e., 5-methylcytosinyl), or 4-amino-5-methyl-2-oxo-1,2-dihydropyrimidin-1-yl having the amino group protected with a protective group for nucleic acid synthesis.

In some embodiments, the modified base or nucleoside analogue has the structure as shown in Chemical Formula I and salts thereof, wherein m is 0, and n is 1.

In some embodiments, the modified base or nucleoside analogue is a DNA oligonucleotide or RNA oligonucleotide analogue, containing one or two or more of one or more types of unit structures of nucleoside analogues having the structure as shown in Chemical Formula II, or a pharmacologically acceptable salt thereof, provided that a form of linking between respective nucleosides in the oligonucleotide analogue may contain one or two or more phosphorothioate bonds [—OP(O)(S$^-$)O—], phosphorodithioate bonds [—O$_2$PS$_2$—], phosphonate bonds [—PO(OH)$_2$—], phosphoramidate bonds [—O=P(OH)$_2$—], or mesyl phosphoramidate bonds [OP(O)(N)(SO$_2$)(CH$_3$)O—] aside from a phosphodiester bond [—OP(O$_2$$^-$)O—] identical with that in a natural nucleic acid, and if two or more of one or more types of these structures are contained, Base may be identical or different between these structures:

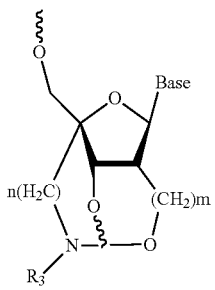

(Chemical Formula II)

where Base represents an aromatic heterocyclic group or aromatic hydrocarbon ring group optionally having a substituent, R$_3$ represents a hydrogen atom, an alkyl group, an alkenyl group, a cycloalkyl group, an aryl group, an aralkyl group, an acyl group, a sulfonyl group, a silyl group, or a functional molecule unit substituent, and m denotes an integer of 0 to 2, and n denotes an integer of 0 to 3. In some embodiments, m and n are 0.

In some embodiments, the oligonucleotide analogue or the pharmacologically acceptable salt thereof has the structure as shown in Chemical Formula II, wherein R$_1$ is a hydrogen atom, an aliphatic acyl group, an aromatic acyl group, an aliphatic or aromatic sulfonyl group, a methyl group substituted by one to three aryl groups, a methyl group substituted by one to three aryl groups having an aryl ring substituted by a lower alkyl, lower alkoxy, halogen, or cyano group, or a silyl group.

In some embodiments, the oligonucleotide analogue or the pharmacologically acceptable salt thereof has the structure as shown in Chemical Formula II, wherein R$_1$ is a hydrogen atom, an acetyl group, a benzoyl group, a methanesulfonyl group, a p-toluenesulfonyl group, a benzyl group, a p-methoxybenzyl group, a trityl group, a dimethoxytrityl group, a monomethoxytrityl group, or a tert-butyldiphenylsilyl group.

In some embodiments, the oligonucleotide analogue or the pharmacologically acceptable salt thereof has the structure as shown in Chemical Formula II, wherein R$_2$ is a hydrogen atom, an aliphatic acyl group, an aromatic acyl group, an aliphatic or aromatic sulfonyl group, a methyl group substituted by one to three aryl groups, a methyl group substituted by one to three aryl groups having an aryl ring substituted by a lower alkyl, lower alkoxy, halogen, or cyano group, a silyl group, a phosphoroamidite group, a phosphonyl group, a phosphate group, or a phosphate group protected with a protective group for nucleic acid synthesis.

In some embodiments, the oligonucleotide analogue or the pharmacologically acceptable salt thereof has the structure as shown in Chemical Formula II, wherein R$_2$ is a hydrogen atom, an acetyl group, a benzoyl group, a benzyl group, a p-methoxybenzyl group, a methanesulfonyl group, a p-toluenesulfonyl group, a tert-butyldiphenylsilyl group, —P(OC$_2$H$_4$CN)(N(i-Pr)$_2$), —P(OCH$_3$)(N(i-Pr)$_2$), a phosphonyl group, or a 2-chlorophenyl- or 4-chlorophenylphosphate group.

In some embodiments, the oligonucleotide analogue or the pharmacologically acceptable salt thereof has the structure as shown in Chemical Formula II, wherein R$_3$ is a hydrogen atom, a phenoxyacetyl group, an alkyl group having 1 to 5 carbon atoms, an alkenyl group having 1 to 5 carbon atoms, an aryl group having 6 to 14 carbon atoms, a methyl group substituted by one to three aryl groups, a lower aliphatic or aromatic sulfonyl group such as a methanesulfonyl group or a p-toluenesulfonyl group, an aliphatic acyl group having 1 to 5 carbon atoms such as an acetyl group, or an aromatic acyl group such as a benzoyl group.

In some embodiments, the oligonucleotide analogue or the pharmacologically acceptable salt thereof has the structure as shown in Chemical Formula II, wherein the functional molecule unit substituent as R$_3$ is a fluorescent or chemiluminescent labeling molecule, a nucleic acid incision activity functional group, or an intracellular or nuclear transfer signal peptide.

In some embodiments, the oligonucleotide analogue or the pharmacologically acceptable salt thereof has the structure as shown in Chemical Formula II, wherein Base is a purin-9-yl group, a 2-oxopyrimidin-1-yl group, or a purin-9-yl group or a 2-oxopyrimidin-1-yl group having a substituent selected from the following a group: a group: A hydroxyl group, a hydroxyl group protected with a protective group for nucleic acid synthesis, an alkoxy group having 1 to 5 carbon atoms, a mercapto group, a mercapto group protected with a protective group for nucleic acid synthesis, an alkylthio group having 1 to 5 carbon atoms, an amino group, an amino group protected with a protective group for nucleic acid synthesis, an amino group substituted by an alkyl group having 1 to 5 carbon atoms, an alkyl group having 1 to 5 carbon atoms, and a halogen atom.

In some embodiments, the oligonucleotide analogue or the pharmacologically acceptable salt thereof has the structure as shown in Chemical Formula II, wherein Base is 6-aminopurin-9-yl (i.e. adeninyl), 6-aminopurin-9-yl having the amino group protected with a protective group for nucleic acid synthesis, 2,6-diaminopurin-9-yl, 2-amino-6-chloropurin-9-yl, 2-amino-6-chloropurin-9-yl having the amino group protected with a protective group for nucleic acid synthesis, 2-amino-6-fluoropurin-9-yl, 2-amino-6-fluoropurin-9-yl having the amino group protected with a protective group for nucleic acid synthesis, 2-amino-6-bromopurin-9-yl, 2-amino-6-bromopurin-9-yl having the amino group protected with a protective group for nucleic acid synthesis, 2-amino-6-hydroxypurin-9-yl (i.e., guaninyl), 2-amino-6-hydroxypurin-9-yl having the amino group protected with a protective group for nucleic acid synthesis, 6-amino-2-methoxypurin-9-yl, 6-amino-2-chloropurin-9-yl, 6-amino-2-fluoropurin-9-yl, 2,6-dimethoxypurin-9-yl, 2,6- dichloropurin-9-yl, 6-mercaptopurin-9-yl, 2-oxo-4-amino-1,2-dihydropyrimidin-1-yl (i.e., cytosinyl), 2-oxo-4-amino-1,2-dihydropyrimidin-1-yl having the amino group protected with a protective group for nucleic acid synthesis, 2-oxo-4-amino-5-fluoro-1,2-dihydropyrimidin-1-yl, 2-oxo-4-amino-5-fluoro-1,2-dihydropyrimidin-1-yl group having the amino group protected with a protective group for nucleic acid synthesis, 4-amino-2-oxo-5-chloro-1,2-dihydropyrimidin-1-yl, 2-oxo-4-methoxy-1,2-dihydropyrimidin-1-yl, 2-oxo-4-mercapto-1,2-dihydropyrimidin-1-yl, 2-oxo-4-hydroxy-1,2-dihydropyrimidin-1-yl (i.e., uracinyl), 2-oxo-4-hydroxy-5-methyl-1,2-dihydropyrimidin-1-yl (i.e., thyminyl), 4-amino-5-methyl-2-oxo-1,2-dihydropyrimidin-1-yl (i.e., 5-methylcytosinyl), or 4-amino-5-methyl-2-oxo-1,2-dihydropyrimidin-1-yl having the amino group protected with a protective group for nucleic acid synthesis.

In some embodiments, the oligonucleotide analogue or the pharmacologically acceptable salt thereof has the structure as shown in Chemical Formula II, wherein m is 0, and n is 1.

In some embodiments, compositions described herein further comprises a polymer (polymer moiety C). In some instances, the polymer is a natural or synthetic polymer, consisting of long chains of branched or unbranched monomers, and/or cross-linked network of monomers in two or three dimensions In some instances, the polymer includes a polysaccharide, lignin, rubber, or polyalkylen oxide (e.g., polyethylene glycol). In some instances, the at least one polymer includes, but is not limited to, alpha-, omega-dihydroxylpolyethyleneglycol, biodegradable lactone-based polymer, e.g. polyacrylic acid, polylactide acid (PLA), poly (glycolic acid) (PGA), polypropylene, polystyrene, polyolefin, polyamide, polycyanoacrylate, polyimide, polyethylenterephthalat (PET, PETG), polyethylene terephthalate (PETE), polytetramethylene glycol (PTG), or polyurethane as well as mixtures thereof. As used herein, a mixture refers to the use of different polymers within the same compound as well as in reference to block copolymers. In some cases, block copolymers are polymers wherein at least one section of a polymer is build up from monomers of another polymer. In some instances, the polymer comprises polyalkylene oxide. In some instances, the polymer comprises PEG. In some instances, the polymer comprises polyethylene imide (PEI) or hydroxy ethyl starch (HES).

In some instances, C is a PEG moiety. In some instances, the PEG moiety is conjugated at the 5' terminus of the oligonucleotide molecule while the binding moiety is conjugated at the 3' terminus of the oligonucleotide molecule. In some instances, the PEG moiety is conjugated at the 3' terminus of the oligonucleotide molecule while the binding moiety is conjugated at the 5' terminus of the oligonucleotide molecule. In some instances, the PEG moiety is conjugated to an internal site of the oligonucleotide molecule. In some instances, the PEG moiety, the binding moiety, or a combination thereof, are conjugated to an internal site of the oligonucleotide molecule. In some instances, the conjugation is a direct conjugation. In some instances, the conjugation is via native ligation.

In some embodiments, the polyalkylene oxide (e.g., PEG) is a polydispers or monodispers compound. In some instances, polydispers material comprises disperse distribution of different molecular weight of the material, characterized by mean weight (weight average) size and dispersity. In some instances, the monodisperse PEG comprises one size of molecules. In some embodiments, C is poly- or monodispersed polyalkylene oxide (e.g., PEG) and the indicated molecular weight represents an average of the molecular weight of the polyalkylene oxide, e.g., PEG, molecules.

In some embodiments, the molecular weight of the polyalkylene oxide (e.g., PEG) is about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da.

In some embodiments, C is polyalkylene oxide (e.g., PEG) and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some embodiments, C is PEG and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some instances, the molecular weight of C is about 200 Da. In some instances, the molecular weight of C is about 300 Da. In some instances, the molecular weight of C is about 400 Da. In some instances, the molecular weight of C is about 500 Da. In some instances, the molecular weight of C is about 600 Da. In some instances, the molecular weight of C is about 700 Da. In some instances, the molecular weight of C is about 800 Da. In some instances, the molecular weight of C is about 900 Da. In some instances, the molecular weight of C is about 1000 Da. In some instances, the molecular weight of C is about 1100 Da. In some instances, the molecular weight of C is about 1200 Da. In some instances, the molecular weight of C is about 1300 Da. In some instances, the molecular weight of C is about 1400 Da. In some instances, the molecular weight of C is about 1450 Da. In some instances, the molecular weight of C is about 1500 Da. In some instances, the molecular weight of C is about 1600 Da. In some instances, the molecular weight of C is about 1700 Da. In some instances, the molecular weight of C is about 1800 Da. In some instances, the molecular weight of C is about 1900 Da. In some instances, the molecular weight of C is about 2000 Da. In some instances, the molecular weight of C is about 2100 Da. In some instances, the molecular weight of C is about 2200 Da. In some instances, the molecular weight of C is about 2300 Da. In some instances, the molecular weight of C is about 2400 Da. In some instances, the molecular weight of C is about 2500 Da. In some instances, the molecular weight of C is about 2600 Da. In some instances, the molecular weight of C is about 2700 Da. In some instances, the molecular weight of C is about 2800 Da. In some instances, the molecular weight of C is about 2900 Da. In some instances, the molecular weight of C is about 3000 Da. In some instances, the molecular weight of C is about 3250 Da. In some instances, the molecular weight of C is about 3350 Da. In some instances, the molecular weight of C is about 3500 Da. In some instances, the molecular weight of C is about 3750 Da. In some instances, the molecular weight of C is about 4000 Da. In some instances, the molecular weight of C is about 4250 Da. In some instances, the molecular weight of C is about 4500 Da. In some instances, the molecular weight of C is about 4600 Da. In some instances, the molecular weight of C is about 4750 Da. In some instances, the molecular weight of C is about 5000 Da. In some instances, the molecular weight of C is about 5500 Da. In some instances, the molecular weight of C is about 6000 Da. In some instances, the molecular weight of C is about 6500 Da. In some instances, the molecular weight of C is about 7000 Da. In some instances, the molecular weight of C is about 7500 Da. In some instances, the molecular weight of C is about 8000 Da. In some instances, the molecular weight of C is about 10,000 Da. In some instances, the molecular weight of C is about 12,000 Da. In some instances, the molecular weight of C is about 20,000 Da. In some instances, the molecular weight of C is about 35,000 Da. In some instances, the molecular weight of C is about 40,000 Da. In some instances, the molecular weight of C is about 50,000 Da. In some instances, the molecular weight of C is about 60,000 Da. In some instances, the molecular weight of C is about 100,000 Da.

In some embodiments, the polyalkylene oxide (e.g., PEG) is a discrete PEG, in which the discrete PEG is a polymeric PEG comprising more than one repeating ethylene oxide units. In some instances, a discrete PEG (dPEG) comprises from 2 to 60, from 2 to 50, or from 2 to 48 repeating ethylene oxide units. In some instances, a dPEG comprises about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units. In some instances, a dPEG comprises about 2 or more repeating ethylene oxide units. In some instances, a dPEG comprises about 3 or more repeating ethylene oxide units. In some instances, a dPEG comprises about 4 or more repeating ethylene oxide units. In some instances, a dPEG comprises about 5 or more repeating ethylene oxide units. In some instances, a dPEG comprises about 6 or more repeating ethylene oxide units. In some instances, a dPEG comprises about 7 or more repeating ethylene oxide units. In some instances, a dPEG comprises about 8 or more repeating ethylene oxide units. In some instances, a dPEG comprises about 9 or more repeating ethylene oxide units. In some instances, a dPEG comprises about 10 or more repeating ethylene oxide units. In some instances, a dPEG comprises about 11 or more repeating ethylene oxide units. In some instances, a dPEG comprises about 12 or more repeating ethylene oxide units. In some instances, a dPEG comprises about 13 or more repeating ethylene oxide units. In some instances, a dPEG comprises about 14 or more repeating ethylene oxide units. In some instances, a dPEG comprises about 15 or more repeating ethylene oxide units. In some instances, a dPEG comprises about 16 or more repeating ethylene oxide units. In some instances, a dPEG comprises about 17 or more repeating ethylene oxide units. In some instances, a dPEG comprises about 18 or more repeating ethylene oxide units. In some instances, a dPEG comprises about 19 or more repeating ethylene oxide units. In some instances, a dPEG comprises about 20 or more repeating ethylene oxide units. In some instances, a dPEG comprises about 22 or more repeating ethylene oxide units. In some instances, a dPEG comprises about 24 or more repeating ethylene oxide units. In some instances, a dPEG comprises about 26 or more repeating ethylene oxide units. In some instances, a dPEG comprises about 28 or more repeating ethylene oxide units. In some instances, a dPEG comprises about 30 or more repeating ethylene oxide units. In some instances, a dPEG comprises about 35 or more repeating ethylene oxide units. In some instances, a dPEG comprises about 40 or more repeating ethylene oxide units. In some instances, a dPEG comprises about 42 or more repeating ethylene oxide units. In some instances, a dPEG comprises about 48 or more repeating ethylene oxide units. In some instances, a dPEG comprises about 50 or more repeating ethylene oxide units. In some cases, a dPEG is synthesized as a single molecular weight compound from pure (e.g., about 95%, 98%, 99%, or 99.5%) staring material in a step-wise fashion. In some cases, a dPEG has a specific molecular weight, rather than an average molecular weight. In some cases, a dPEG described herein is a dPEG from Quanta Biodesign, LMD.

In some embodiments, C is an albumin binding domain. In certain aspects, the albumin binding domain specifically binds to serum albumin, e.g., human serum albumin (HSA) to prolong the half-life of the domain or of another therapeutic to which the albumin-binding domain is associated or linked with. In some embodiments, the human serum albumin-binding domain comprises an initiator methionine (Met) linked to the N-terminus of the molecule. In some embodiments, the human serum albumin-binding domain comprise a cysteine (Cys) linked to a C-terminus or the N-terminus of the domain. The addition of the N-terminal Met and/or the C-terminal Cys may facilitate expression and/or conjugation to another molecule, which can be another half-life extending molecules, such as PEG, a Fc region, and the like.

In some embodiments, the albumin binding domain comprises the amino acid sequence of SEQ ID NOs: 101, 102, 103, 104, 105, 106, 107, 108, 109, 110, 111, 112, 113, 114, 115, 116, 117, 118, or 119, provided in Table 8. In some embodiments, the albumin binding domain (protein) is isolated. In some embodiments, the albumin binding domain comprises an amino acid sequence that is at least, or is, 85%, 86%, 87%, 88%, 89%, 90%, 91%, 92%, 93%, 94%, 95%, 96%, 97%, 98%, or 99% identical to the amino acid sequence of SEQ ID NO: 101, 102, 103, 104, 105, 106, 107, 108, 109, 110, 111, 112, 113, 114, 115, 116, 117, 118, or 119. In some embodiments, the albumin binding domain comprises an amino acid sequence that is at least, or is, 85%, 86%, 87%, 88%, 89%, 90%, 901%, 92%, 93%, 94%, 95%, 96%, 97%, 98%, or 99% identical to the amino acid sequence of SEQ ID NO: 101, 102, 103, 104, 105, 106, 107, 108, 109, 110, 111, 112, 113, 114, 115, 116, 117, 118, or 119 provided that the protein has a substitution that corresponds to position 10 of SEQ ID NO: 101, 102, 103, 104, 105, 106, 107, 108, 109, 110, 111, 112, 113, 114, 115, 116, 117, 118, or 119. In some embodiments, the substitution is A10V. In some embodiments, the substitution is A10G, A10L, A10I, A10T, or AT0S. In some embodiments, the substitution at position 10 is any naturally occurring amino acid. In some embodiments, the isolated albumin binding domain comprises an amino acid sequence that has 1, 2, 3, 4, 5, 6, 7, 8, 9, 10, 11, 12, 13, or 14 substitutions when compared to the amino acid sequence of SEQ ID NOs: 101, 102, 103, 104, 105, 106, 107, 108, 109, 110, 111, 112, 113, 114, 115, 116, 117, 118, or 119. In some embodiments, the substitution is at a position that corresponds to position 10 of SEQ ID NOs: 101, 102, 103, 104, 105, 106, 107, 108, 109, 110, 111, 112, 113, 114, 115, 116, 117, 118, or 119. In some embodiments, FN3 domains provided comprises a cysteine residue in at least one residue position corresponding to residue positions 6, 11, 22, 25, 26, 52, 53, 61, 88 or positions 6, 8, 10, 11, 14, 15, 16, 20, 30, 34, 38, 40, 41, 45, 47, 48, 53, 54, 59, 60, 62, 64, 70, 88, 89, 90, 91, or 93 of SEQ ID NO: 101, 102, 103, 104, 105, 106, 107, 108, 109, 110, 111, 112, 113, 114, 115, 116, 117, 118, or 119, or at a C-terminus. Although the positions are listed in a series, each position can also be chosen individually. In some embodiments, the cysteine is at a position that corresponds to position 6, 53, or 88. In some embodiments, additional examples of albumin binding domains can be found in U.S. Pat. No. 10,925,932, which hereby incorporated by reference.

TABLE 8

| SEQ ID NO: | SEQUENCE |
|---|---|
| 101 | MLPAPKNLVASRVTEDSARLSWTAPDAAFDSFNIAYWEPGIGGEA IWLRVPGSERSYDLTGLKPGTEYKVWIHGVKGGASSPPLIARFTT |
| 102 | MLPAPKNLVVSRVTEDSARLSWTAPDAAFDSFNIAYWEPGIGGEA IWLRVPGSERSYDLTGLKPGTEYKVWIHGVKGGASSPPLIARFTT |
| 103 | MLPAPKNLVVSRVTEDSARLSWTAPDAAFDSFAIAYWEPGIGGEA IWLRVPGSERSYDLTGLKPGTEYKVWIHGVKGGASSPPLIARFTT |
| 104 | MLPAPKNLVVSRVTEDSARLSWTAPDAAFDSFNISYWEPGIGGEA IWLRVPGSERSYDLTGLKPGTEYKVWIHGVKGGASSPPLIARFTT |
| 105 | MLPAPKNLVVSRVTEDSARLSWTAPDAAFDSFNIAYAEPGIGGEA IWLRVPGSRSYDLTGLKPGTEYKVWIHGVKGGASSPPLIARFTT |
| 106 | MLPAPKNLVVSRVTEDSARLSWTAPDAAFDSFNIAYWEAGIGGEA IWLRVPGSERSYDLTGLKPGTEYKVWIHGVKGGASSPPLIARFTT |
| 107 | MLPAPKNLVVSRVTEDSARLSWTAPDAAFDSFNIAYWEPAIGGEA IWLRVPGSERSYDLTGLKPGTEYKVWIHGVKGGASSPPLIARFTT |
| 108 | MLPAPKNLVVSRVTEDSARLSWTAPDAAFDSFNIAYWEPGAGGEA IWLRVPGSERSYDLTGLKPGTEYKVWIHGVKGGASSPPLIARFTT |
| 109 | MLPAPKNLVVSRVTEDSARLSWTAPDAAFDSFNIAYWEPGIAGEA IWLRVPGSERSYDLTGLKPGTEYKVWIHGVKGGASSPPLIARFTT |
| 110 | MLPAPKNLVVSRVTEDSARLSWTAPDAAFDSFNIAYWEPGIGGEA IALRVPGSERSYDLTGLKPGTEYKVWIHGVKGGASSPPLIARFTT |
| 111 | MLPAPKNLVVSRVTEDSARLSWTAPDAAFDSFNIAYWEPGIGGEA IWLAVPGSERSYDLTGLKPGTEYKVWIHGVKGGASSPPLIARFTT |
| 112 | MLPAPKNLVVSRVTEDSARLSWTAPDAAFDSFNIAYWEPGIGGEA IWLRVPGSERSYDLTGLKPGTEYAVWIHGVKGGASSPPLIARFTT |
| 113 | MLPAPKNLVVSRVTEDSARLSWTAPDAAFDSFNIAYWEPGIGGEA IWLRVPGSERSYDLTGLKPGTEYKVAIHGVKGGASSPPLIARFTT |
| 114 | MLPAPKNLVVSRVTEDSARLSWTAPDAAFDSFNIAYWEPGIGGEA IWLRVPGSERSYDLTGLKPGTEYKVWIAGVKGGASSPPLIARFTT |
| 115 | MLPAPKNLVVSRVTEDSARLSWTAPDAAFDSFNIAYWEPGIGGEA IWLRVPGSERSYDLTGLKPGTEYKVWIHGVKGGSSSPPLIARFTT |
| 116 | MLPAPKNLVVSRVTEDSARLSWTAPDAAFDSFNIAYWEPGIGGEA IWLRVPGSERSYDLTGLKPGTEYKVWIHGVKGGAASPPLIARFTT |
| 117 | MLPAPKNLVVSRVTEDSARLSWTAPDAAFDSFNIAYWEPGIGGEA IWLRVPGSERSYDLTGLKPGTEYKVWIHGVKGGASSAPLIARFTT |
| 118 | MLPAPKNLVVSRVTEDSARLSWTAPDAAFDSFNIAYWEPGIGGEA IWLRVPGSERSYDLTGLKPGTEYKVWIHGVKGGASSPLAARFTT |
| 119 | MLPAPKNLVVSRVTEDSARLSWTAPDAAFDSFNIAYWEPGIGGEA IWLRVPGSERSYDLTGLKPGTEYKVWIHGVKGGASSPPLIAAFTT |

In some embodiments, the dsRNA agent comprises mismatch(es) with the target, within the duplex, or combinations thereof. The mismatch can occur in the overhang region or the duplex region. The base pair can be ranked on the basis of their propensity to promote dissociation or melting (e.g., on the free energy of association or dissociation of a particular pairing, the simplest approach is to examine the pairs on an individual pair basis, though next neighbor or similar analysis can also be used). In terms of promoting dissociation: A:U is preferred over G:C; G:U is preferred over G:C; and I:C is preferred over G:C (I=inosine). Mismatches, e.g., non-canonical or other than canonical pairings (as described elsewhere herein) are preferred over canonical (A:T, A:U, G:C) pairings; and pairings which include a universal base are preferred over canonical pairings.

In some embodiments, the dsRNA agent can comprise a phosphorus-containing group at the 5'-end of the sense strand or antisense strand. The 5'-end phosphorus-containing group can be 5'-end phosphate (5'-P), 5'-end phosphorothioate (5'-PS), 5'-end phosphorodithioate (5'-PS$_2$), 5'-end vinylphosphonate (5'-VP), 5'-end methylphosphonate (MePhos), 5'-end mesyl phosphoramidate (5'MsPA), or 5'-deoxy-5'-C-malonyl. When the 5'-end phosphorus-containing group is 5'-end vinylphosphonate (5'-VP), the 5'-VP can be either 5'-E-VP isomer, such as trans-vinylphosphate or cis-vinylphosphate, or mixtures thereof. Representative structures of these modifications can be found in, for example, U.S. Pat. No. 10,233,448, which is hereby incorporated by reference in its entirety.

In some embodiments, nucleotide analogues or synthetic nucleotide base comprise a nucleic acid with a modification at a 2' hydroxyl group of the ribose moiety. In some instances, the modification includes an H, OR, R, halo, SH, SR, NH2, NHR, NR2, or CN, wherein R is an alkyl moiety. Exemplary alkyl moiety includes, but is not limited to, methyl, ethyl, n-propyl, iso-propyl, n-butyl, iso-butyl, tert-butyl, $C_1$-$C_{10}$ chain lengths both linear and branched. In some instances, the alkyl moiety further comprises a modification. In some instances, the modification comprises an azo group, a keto group, an aldehyde group, a carboxyl group, a nitro group, a nitroso, group, a nitrile group, a heterocycle (e.g., imidazole, hydrazine or hydroxylamino) group, an isocyanate or cyanate group, or a sulfur containing group (e.g., sulfoxide, sulfone, sulfide, and disulfide). In some instances, the alkyl moiety further comprises additional hetero atom such as O, S, N, Se and each of these hetero atoms can be further substituted with alky groups as described above. In some instances, the carbon of the heterocyclic group is substituted by a nitrogen, oxygen or sulfur. In some instances, the heterocyclic substitution includes but is not limited to, morpholino, imidazole, and pyrrolidino.

In some instances, the modification at the 2' hydroxyl group is a 2'-O-methyl modification or a 2'-O-methoxyethyl (2'-O-MOE) modification. Exemplary chemical structures of a 2'-O-methyl modification of an adenosine molecule and 2'O-methoxyethyl modification of an uridine are illustrated below.

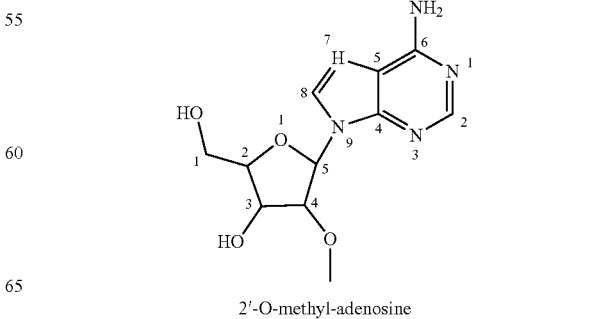

2'-O-methyl-adenosine

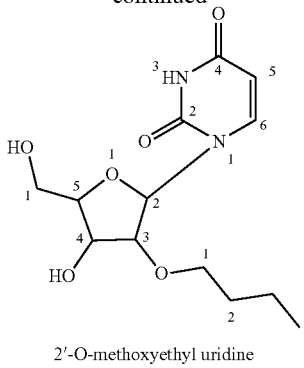

2'-O-methoxyethyl uridine

In some instances, the modification at the 2' hydroxyl group is a 2'-O-aminopropyl modification in which an extended amine group comprising a propyl linker binds the amine group to the 2' oxygen. In some instances, this modification neutralizes the phosphate derived overall negative charge of the oligonucleotide molecule by introducing one positive charge from the amine group per sugar and thereby improves cellular uptake properties due to its zwitterionic properties. An exemplary chemical structure of a 2'-O-aminopropyl nucleoside phosphoramidite is illustrated below.

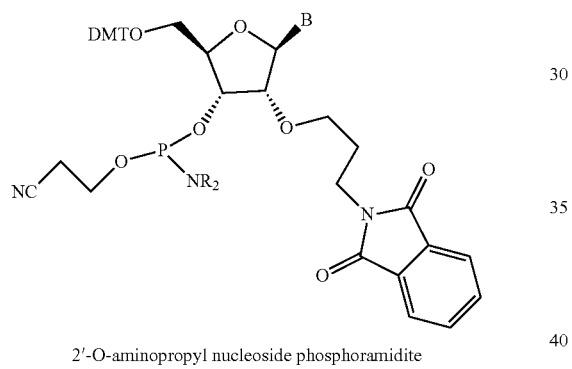

2'-O-aminopropyl nucleoside phosphoramidite

In some instances, the modification at the 2' hydroxyl group is a locked or bridged ribose modification (e.g., locked nucleic acid or LNA) in which the oxygen molecule bound at the 2' carbon is linked to the 4' carbon by a methylene group, thus forming a 2'-C, 4'-C-oxy-methylene-linked bicyclic ribonucleotide monomer. Exemplary representations of the chemical structure of LNA are illustrated below. The representation shown to the left highlights the chemical connectivities of an LNA monomer. The representation shown to the right highlights the locked 3'-endo (3E) conformation of the furanose ring of an LNA monomer.

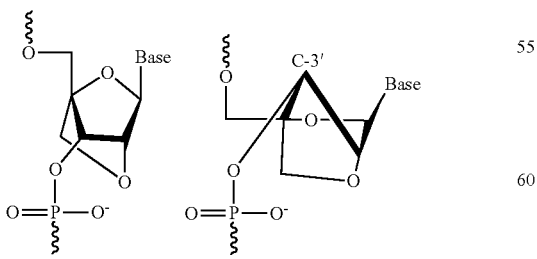

LNA (Locked Nucleic Acids)

In some instances, the modification at the 2' hydroxyl group comprises ethylene nucleic acids (ENA) such as for example 2'-4'-ethylene-bridged nucleic acid, which locks the sugar conformation into a C3'-endo sugar puckering conformation. ENA are part of the bridged nucleic acids class of modified nucleic acids that also comprises LNA. Exemplary chemical structures of the ENA and bridged nucleic acids are illustrated below.

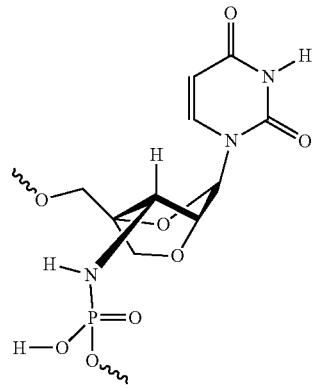

3'-amino-2',4'–BNA

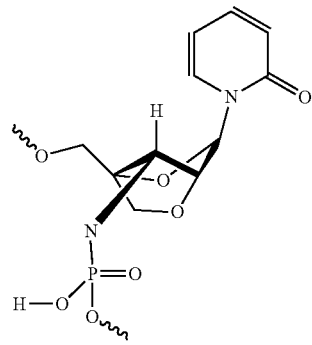

2',4'–BNA–2-pyridone

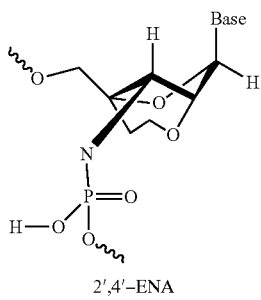

2',4'–ENA

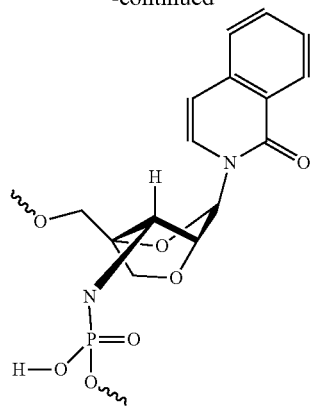

2',4'-BNA-1-isoquinolone

In some embodiments, additional modifications at the 2' hydroxyl group include 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA).

In some embodiments, nucleotide analogues comprise modified bases such as, but not limited to, 5-propynyluridine, 5-propynylcytidine, 6-methyladenine, 6-methylguanine, N, N, dimethyladenine, 2-propyladenine, 2propylguanine, 2-aminoadenine, 1-methylinosine, 3-methyluridine, 5-methylcytidine, 5-methyluridine and other nucleotides having a modification at the 5 position, 5-(2-amino) propyl uridine, 5-halocytidine, 5-halouridine, 4-acetylcytidine, 1-methyladenosine, 2-methyladenosine, 3-methylcytidine, 6-methyluridine, 2-methylguanosine, 7-methylguanosine, 2, 2-dimethylguanosine, 5-methylaminoethyluridine, 5-methyloxyuridine, deazanucleotides such as 7-deaza-adenosine, 6-azouridine, 6-azocytidine, 6-azothymidine, 5-methyl-2-thiouridine, other thio bases such as 2-thiouridine and 4-thiouridine and 2-thiocytidine, dihydrouridine, pseudouridine, queuosine, archaeosine, naphthyl and substituted naphthyl groups, any O- and N-alkylated purines and pyrimidines such as N6-methyladenosine, 5-methylcarbonylmethyluridine, uridine 5-oxyacetic acid, pyridine-4-one, pyridine-2-one, phenyl and modified phenyl groups such as aminophenol or 2,4, 6-trimethoxy benzene, modified cytosines that act as G-clamp nucleotides, 8-substituted adenines and guanines, 5-substituted uracils and thymines, azapyrimidines, carboxyhydroxyalkyl nucleotides, carboxyalkylaminoalkyl nucleotides, and alkylcarbonylalkylated nucleotides. Modified nucleotides also include those nucleotides that are modified with respect to the sugar moiety, as well as nucleotides having sugars or analogs thereof that are not ribosyl. For example, the sugar moieties, in some cases are or be based on, mannoses, arabinoses, glucopyranoses, galactopyranoses, 4'-thioribose, and other sugars, heterocycles, or carbocycles. The term nucleotide also includes what are known in the art as universal bases. By way of example, universal bases include but are not limited to 3-nitropyrrole, 5-nitroindole, or nebularine.

In some embodiments, nucleotide analogues further comprise morpholinos, peptide nucleic acids (PNAs), methylphosphonate nucleotides, thiolphosphonate nucleotides, 2'-fluoro N3-P5'-phosphoramidites, 5'-anhydrohexitol nucleic acids (HNAs), or a combination thereof. Morpholino or phosphorodiamidate morpholino oligo (PMO) comprises synthetic molecules whose structure mimics natural nucleic acid structure by deviates from the normal sugar and phosphate structures. In some instances, the five-member ribose ring is substituted with a six member morpholino ring containing four carbons, one nitrogen and one oxygen. In some cases, the ribose monomers are linked by a phosphordiamidate group instead of a phosphate group. In such cases, the backbone alterations remove all positive and negative charges making morpholinos neutral molecules capable of crossing cellular membranes without the aid of cellular delivery agents such as those used by charged oligonucleotides.

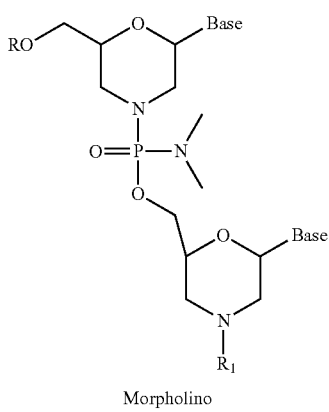

Morpholino

In some embodiments, peptide nucleic acid (PNA) does not contain sugar ring or phosphate linkage and the bases are attached and appropriately spaced by oligoglycine-like molecules, therefore, eliminating a backbone charge.

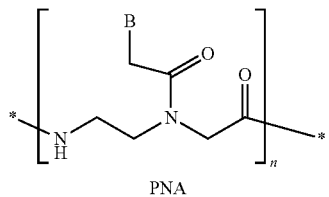

PNA

In some embodiments, one or more modifications optionally occur at the internucleotide linkage. In some instances, modified internucleotide linkage include, but is not limited to, phosphorothioates, mesyl phosphoramidate, phosphorodithioates, methylphosphonates, 5'-alkylenephosphonates, 5'-methylphosphonate, 3'-alkylene phosphonates, borontrifluoridates, borano phosphate esters and selenophosphates of 3'-5' linkage or 2'-5' linkage, phosphotriesters, thionoalkylphosphotriesters, hydrogen phosphonate linkages, alkyl phosphonates, alkylphosphonothioates, arylphosphonothioates, phosphoroselenoates, phosphorodiselenoates, phosphinates, phosphoramidates, 3'-alkylphosphoramidates, aminoalkylphosphoramidates, thionophosphoramidates, phosphoropiperazidates, phosphoroanilothioates, phosphoroanilidates, ketones, sulfones, sulfonamides, carbonates, carbamates, methylenehydrazos, methylenedimethylhydrazos, formacetals, thioformacetals, oximes, methyleneiminos, methylenemethyliminos, thioamidates, linkages with riboacetyl groups, aminoethyl glycine, silyl or siloxane linkages, alkyl or cycloalkyl linkages with or without heteroatoms of, for example, 1 to 10 carbons that are saturated or unsaturated and/or substituted and/or contain heteroatoms, linkages with morpholino structures, amides, polyamides wherein the bases are attached to the aza nitrogens of the backbone directly or indirectly, and combinations thereof. Phosphorothioate antisense oligonucleotides (PS ASO) are antisense oligonucleotides comprising a phosphorothioate linkage. Mesyl phosphoramidate antisense oligonucleotides (MsPA ASO) are antisense oligonucleotides comprising a mesyl phosphoramidate linkage.

In some instances, the modification is a methyl or thiol modification such as methylphosphonate, mesyl phosphoramidate, or thiolphosphonate modification. In some instances, a modified nucleotide includes, but is not limited to, 2'-fluoro N3-P5'-phosphoramidites.

In some instances, a modified nucleotide includes, but is not limited to, hexitol nucleic acid (or 5'-anhydrohexitol nucleic acids (HNA)).

In some embodiments, one or more modifications further optionally include modifications of the ribose moiety, phosphate backbone and the nucleoside, or modifications of the nucleotide analogues at the 3' or the 5' terminus. For example, the 3' terminus optionally include a 3' cationic group, or by inverting the nucleoside at the 3'-terminus with a 3'-3' linkage. In another alternative, the 3'-terminus is optionally conjugated with an aminoalkyl group, e.g., a 3' C5-aminoalkyl dT. In an additional alternative, the 3'-terminus is optionally conjugated with an abasic site, e.g., with an apurinic or apyrimidinic site. In some instances, the 5'-terminus is conjugated with an aminoalkyl group, e.g., a 5'-O-alkylamino substituent. In some cases, the 5'-terminus is conjugated with an abasic site, e.g., with an apurinic or apyrimidinic site.

In some embodiments, the oligonucleotide molecule comprises one or more of the synthetic nucleotide analogues described herein. In some instances, the oligonucleotide molecule comprises 1, 2, 3, 4, 5, 6, 7, 8, 9, 10, 11, 12, 13, 14, 15, 16, 17, 18, 20, 25, or more of the synthetic nucleotide analogues described herein. In some embodiments, the synthetic nucleotide analogues include 2'-O-methyl, 2'-O-methoxyethyl (2'-O-M0E), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-0-dimethylaminopropyl (2'-O-DMAP), 2'-O-dimethylaminoethyloxyethyl (2'-O-DMAEOE), or 2'-O-N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the oligonucleotide molecule comprises 1, 2, 3, 4, 5, 6, 7, 8, 9, 10, 11, 12, 13, 14, 15, 16, 17, 18, 20, 25, or more of the synthetic nucleotide analogues selected from 2'-O-methyl, 2'-O-methoxyethyl (2'-O-M0E), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof. In some instances, the oligonucleotide molecule comprises 1, 2, 3, 4, 5, 6, 7, 8, 9, 10, 11, 12, 13, 14, 15, 16, 17, 18, 20, 25, or more of 2'-O-methyl modified nucleotides. In some instances, the oligonucleotide molecule comprises 1, 2, 3, 4, 5, 6, 7, 8, 9, 10, 11, 12, 13, 14, 15, 16, 17, 18, 20,25, or more of 2'-O-methoxyethyl (2'-O-MOE) modified nucleotides. In some instances, the oligonucleotide molecule comprises 1, 2, 3, 4, 5, 6, 7, 8, 9, 10, 11, 12, 13, 14, 15, 16, 17, 18, 20, 25, or more of thiolphosphonate nucleotides.

In some instances, the oligonucleotide molecule comprises at least one of: from about 5% to about 100% modification, from about 10% to about 100% modification, from about 20% to about 100% modification, from about 30% to about 100% modification, from about 40% to about 100% modification, from about 50% to about 100% modification, from about 60% to about 100% modification, from about 70% to about 100% modification, from about 80% to about 100% modification, and from about 90% to about 100% modification. In some instances, the oligonucleotide molecule comprises 100% modification In some cases, the oligonucleotide molecule comprises at least one of: from about 10% to about 90% modification, from about 20% to about 90% modification, from about 30% to about 90% modification, from about 40% to about 90% modification, from about 50% to about 90% modification, from about 60% to about 90% modification, from about 70% to about 90% modification, and from about 80% to about 100% modification.

In some cases, the oligonucleotide molecule comprises at least one of: from about 10% to about 80% modification, from about 20% to about 80% modification, from about 30% to about 80% modification, from about 40% to about 80% modification, from about 50% to about 80% modification, from about 60% to about 80% modification, and from about 70% to about 80% modification.

In some instances, the oligonucleotide molecule comprises at least one of: from about 10% to about 70% modification, from about 20% to about 70% modification, from about 30% to about 70% modification, from about 40% to about 70% modification, from about 50% to about 70% modification, and from about 60% to about 70% modification.

In some instances, the oligonucleotide molecule comprises at least one of: from about 10% to about 60% modification, from about 20% to about 60% modification, from about 30% to about 60% modification, from about 40% to about 60% modification, and from about 50% to about 60% modification.

In some cases, the oligonucleotide molecule comprises at least one of: from about 10% to about 50% modification, from about 20% to about 50% modification, from about 30% to about 50% modification, and from about 40% to about 50% modification.

In some cases, the oligonucleotide molecule comprises at least one of: from about 10% to about 40% modification, from about 20% to about 40% modification, and from about 30% to about 40% modification.

In some cases, the oligonucleotide molecule comprises at least one of: from about 10% to about 30% modification, and from about 20% to about 30% modification.

In some cases, the oligonucleotide molecule comprises from about 10% to about 20% modification.

In some cases, the oligonucleotide molecule comprises from about 15% to about 90%, from about 20% to about 80%, from about 30% to about 70%, or from about 40% to about 60% modifications.

In additional cases, the oligonucleotide molecule comprises at least about 15%, 20%, 30%, 40%, 50%, 60%, 70%, 80%, 90%, 95%, or 99% modification.

In some embodiments, the oligonucleotide molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, or about 40 modifications.

In some instances, the oligonucleotide molecule comprises at least about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 31, about 32, about 33, about 34, about 35, about 36, about 37, about 38, about 39, or about 40 modified nucleotides.

In some instances, from about 5 to about 100% of the oligonucleotide molecule comprise the synthetic nucleotide analogues described herein. In some instances, about 5%, 10%, 15%, 20%, 25%, 30%, 35%, 40%, 45%, 50%, 55%, 60%, 65%, 70%, 75%, 80%, 85%, 90%, 95% or 100% of the oligonucleotide molecule comprise the synthetic nucleotide analogues described herein. In some instances, about 5% of the oligonucleotide molecule comprises the synthetic nucleotide analogues described herein. In some instances, about 10% of the oligonucleotide molecule comprises the synthetic nucleotide analogues described herein. In some instances, about 15% of the oligonucleotide molecule comprises the synthetic nucleotide analogues described herein. In some instances, about 20% of the oligonucleotide molecule comprises the synthetic nucleotide analogues described herein. In some instances, about 25% of the oligonucleotide molecule comprises the synthetic nucleotide analogues described herein. In some instances, about 30% of the oligonucleotide molecule comprises the synthetic nucleotide analogues described herein. In some instances, about 35% of the oligonucleotide molecule comprises the synthetic nucleotide analogues described herein. In some instances, about 40% of the oligonucleotide molecule comprises the synthetic nucleotide analogues described herein. In some instances, about 45% of the oligonucleotide molecule comprises the synthetic nucleotide analogues described herein. In some instances, about 50% of the oligonucleotide molecule comprises the synthetic nucleotide analogues described herein. In some instances, about 55% of the oligonucleotide molecule comprises the synthetic nucleotide analogues described herein. In some instances, about 60% of the oligonucleotide molecule comprises the synthetic nucleotide analogues described herein. In some instances, about 65% of the oligonucleotide molecule comprises the synthetic nucleotide analogues described herein. In some instances, about 70% of the oligonucleotide molecule comprises the synthetic nucleotide analogues described herein. In some instances, about 75% of the oligonucleotide molecule comprises the synthetic nucleotide analogues described herein. In some instances, about 80% of the oligonucleotide molecule comprises the synthetic nucleotide analogues described herein. In some instances, about 85% of the oligonucleotide molecule comprises the synthetic nucleotide analogues described herein. In some instances, about 90% of the oligonucleotide molecule comprises the synthetic nucleotide analogues described herein. In some instances, about 95% of the oligonucleotide molecule comprises the synthetic nucleotide analogues described herein. In some instances, about 96% of the oligonucleotide molecule comprises the synthetic nucleotide analogues described herein. In some instances, about 97% of the oligonucleotide molecule comprises the synthetic nucleotide analogues described herein. In some instances, about 98% of the oligonucleotide molecule comprises the synthetic nucleotide analogues described herein. In some instances, about 99% of the oligonucleotide molecule comprises the synthetic nucleotide analogues described herein. In some instances, about 100% of the oligonucleotide molecule comprises the synthetic nucleotide analogues described herein. In some embodiments, the synthetic nucleotide analogues include 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-0-N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or a combination thereof.

In some embodiments, the oligonucleotide molecule comprises from about 1 to about 25 modifications in which the modification comprises an synthetic nucleotide analogues described herein. In some embodiments, the oligonucleotide molecule comprises about 1 modification in which the modification comprises a synthetic nucleotide analogue described herein. In some embodiments, the oligonucleotide molecule comprises about 2 modifications in which the modifications comprise a synthetic nucleotide analogue described herein. In some embodiments, the oligonucleotide molecule comprises about 3 modifications in which the modifications comprise a synthetic nucleotide analogue described herein. In some embodiments, the oligonucleotide molecule comprises about 4 modifications in which the modifications comprise a synthetic nucleotide analogue described herein. In some embodiments, the oligonucleotide molecule comprises about 5 modifications in which the modifications comprise a synthetic nucleotide analogue described herein. In some embodiments, the oligonucleotide molecule comprises about 6 modifications in which the modifications comprise a synthetic nucleotide analogue described herein. In some embodiments, the oligonucleotide molecule comprises about 7 modifications in which the modifications comprise a synthetic nucleotide analogue described herein. In some embodiments, the oligonucleotide molecule comprises about 8 modifications in which the modifications comprise a synthetic nucleotide analogue described herein. In some embodiments, the oligonucleotide molecule comprises about 9 modifications in which the modifications comprise a synthetic nucleotide analogue described herein. In some embodiments, the oligonucleotide molecule comprises about 10 modifications in which the modifications comprise a synthetic nucleotide analogue described herein. In some embodiments, the oligonucleotide molecule comprises about 11 modifications in which the modifications comprise a synthetic nucleotide analogue described herein. In some embodiments, the oligonucleotide molecule comprises about 12 modifications in which the modifications comprise a synthetic nucleotide analogue described herein. In some embodiments, the oligonucleotide molecule comprises about 13 modifications in which the modifications comprise a synthetic nucleotide analogue described herein. In some embodiments, the oligonucleotide molecule comprises about 14 modifications in which the modifications comprise a synthetic nucleotide analogue described herein. In some embodiments, the oligonucleotide molecule comprises about 15 modifications in which the modifications comprise a synthetic nucleotide analogue described herein. In some embodiments, the oligonucleotide molecule comprises about 16 modifications in which the modifications comprise a synthetic nucleotide analogue described herein. In some embodiments, the oligonucleotide molecule comprises about 17 modifications in which the modifications comprise a synthetic nucleotide analogue described herein. In some embodiments, the oligonucleotide molecule comprises about 18 modifications in which the modifications comprise a synthetic nucleotide analogue described herein. In some embodiments, the oligonucleotide molecule comprises about 19 modifications in which the modifications comprise a synthetic nucleotide analogue described herein. In some embodiments, the oligonucleotide molecule comprises about 20 modifications in which the modifications comprise a synthetic nucleotide analogue described herein. In some embodiments, the oligonucleotide molecule comprises about 21 modifications in which the modifications comprise a synthetic nucleotide analogue described herein. In some embodiments, the oligonucleotide molecule comprises about 22 modifications in which the modifications comprise a synthetic nucleotide analogue described herein. In some embodiments, the oligonucleotide molecule comprises about 23 modifications in which the modifications comprise a synthetic nucleotide analogue described herein. In some embodiments, the oligonucleotide molecule comprises about 24 modifications in which the modifications comprise a synthetic nucleotide analogue described herein. In some embodiments, the oligonucleotide molecule comprises about 25 modifications in which the modifications comprise a synthetic nucleotide analogue described herein. In some embodiments, the oligonucleotide molecule comprises about 26 modifications in which the modifications comprise a synthetic nucleotide analogue described herein. In some embodiments, the oligonucleotide molecule comprises about 27 modifications in which the modifications comprise a synthetic nucleotide analogue described herein. In some embodiments, the oligonucleotide molecule comprises about 28 modifications in which the modifications comprise a synthetic nucleotide analogue described herein. In some embodiments, the oligonucleotide molecule comprises about 29 modifications in which the modifications comprise a synthetic nucleotide analogue described herein. In some embodiments, the oligonucleotide molecule comprises about 30 modifications in which the modifications comprise a synthetic nucleotide analogue described herein. In some embodiments, the oligonucleotide molecule comprises about 31 modifications in which the modifications comprise a synthetic nucleotide analogue described herein. In some embodiments, the oligonucleotide molecule comprises about 32 modifications in which the modifications comprise a synthetic nucleotide analogue described herein. In some embodiments, the oligonucleotide molecule comprises about 33 modifications in which the modifications comprise a synthetic nucleotide analogue described herein. In some embodiments, the oligonucleotide molecule comprises about 34 modifications in which the modifications comprise a synthetic nucleotide analogue described herein. In some embodiments, the oligonucleotide molecule comprises about 35 modifications in which the modifications comprise a synthetic nucleotide analogue described herein. In some embodiments, the oligonucleotide molecule comprises about 36 modifications in which the modifications comprise a synthetic nucleotide analogue described herein. In some embodiments, the oligonucleotide molecule comprises about 37 modifications in which the modifications comprise a synthetic nucleotide analogue described herein. In some embodiments, the oligonucleotide molecule comprises about 38 modifications in which the modifications comprise a synthetic nucleotide analogue described herein. In some embodiments, the oligonucleotide molecule comprises about 39 modifications in which the modifications comprise a synthetic nucleotide analogue described herein. In some embodiments, the oligonucleotide molecule comprises about 40 modifications in which the modifications comprise a synthetic nucleotide analogue described herein.

In some embodiments, an oligonucleotide molecule is assembled from two separate polynucleotides wherein one polynucleotide comprises the sense strand and the second polynucleotide comprises the antisense strand of the oligonucleotide molecule. In other embodiments, the sense strand is connected to the antisense strand via a linker molecule, which in some instances is a polynucleotide linker or a non-nucleotide linker.

In some embodiments, an oligonucleotide molecule comprises a sense strand and antisense strand, wherein pyrimidine nucleotides in the sense strand comprises 2'-O-methylpyrimidine nucleotides and purine nucleotides in the sense strand comprise 2'-deoxy purine nucleotides. In some embodiments, an oligonucleotide molecule comprises a sense strand and antisense strand, wherein pyrimidine nucleotides present in the sense strand comprise 2'-deoxy-2'-fluoro pyrimidine nucleotides and wherein purine nucleotides present in the sense strand comprise 2'-deoxy purine nucleotides.

In some embodiments, an oligonucleotide molecule comprises a sense strand and antisense strand, wherein the pyrimidine nucleotides when present in said antisense strand are 2'-deoxy-2'-fluoro pyrimidine nucleotides and the purine nucleotides when present in said antisense strand are 2'-O-methyl purine nucleotides.

In some embodiments, an oligonucleotide molecule comprises a sense strand and antisense strand, wherein the pyrimidine nucleotides when present in said antisense strand are 2'-deoxy-2'-fluoro pyrimidine nucleotides and wherein the purine nucleotides when present in said antisense strand comprise 2'-deoxy-purine nucleotides.

In some embodiments, an oligonucleotide molecule comprises a sense strand and antisense strand, and at least one of sense strand and antisense strands has a plurality of (e.g., two or more, three or more, four or more, five or more, six or more, seven or more, eight or more, etc) 2'-O-methyl or 2'-deoxy-2'-fluoro modified nucleotides. In some embodiments, at least two, three, four, five, six, or seven out of the a plurality of 2'-O-methyl or 2'-deoxy-2'-fluoro modified nucleotides are consecutive nucleotides. In some embodiments, consecutive 2'-O-methyl or 2'-deoxy-2'-fluoro modified nucleotides are located at the 5'-end of the sense strand and/or the antisense strand. In some embodiments, consecutive 2'-O-methyl or 2'-deoxy-2'-fluoro modified nucleotides are located at the 3'-end of the sense strand and/or the antisense strand. In some embodiments, the sense strand of oligonucleotide molecule includes at least four, at least five, at least six consecutive 2'-O-methyl modified nucleotides at its 5' end and/or 3' end, or both. Optionally, in such embodiments, the sense strand of oligonucleotide molecule includes at least one, at least two, at least three, at least four 2'-deoxy-2'-fluoro modified nucleotides at the 3' end of the at least four, at least five, at least six consecutive 2'-O-methyl modified nucleotides at the polynucleotides' 5' end, or at the 5' end of the at least four, at least five, at least six consecutive 2'-O-methyl modified nucleotides at polynucleotides' 3' end. Also optionally, such at least two, at least three, at least four 2'-deoxy-2'-fluoro modified nucleotides are consecutive nucleotides.

In some embodiments, an oligonucleotide molecule comprises a sense strand and antisense strand, and at least one of sense strand and antisense strand has 2'-O-methyl modified nucleotide located at the 5'-end of the sense strand and/or the antisense strand. In some embodiments, at least one of sense strand and antisense strands has 2'-O-methyl modified nucleotide located at the 3'-end of the sense strand and/or the antisense strand. In some embodiments, the 2'-O-methyl modified nucleotide located at the 5'-end of the sense strand and/or the antisense strand is a purine nucleotide. In some embodiments, the 2'-O-methyl modified nucleotide located at the 5'-end of the sense strand and/or the antisense strand is a pyrimidine nucleotide.

In some embodiments, an oligonucleotide molecule comprises a sense strand and antisense strand, and one of sense strand and antisense strand has at least two consecutive 2'-deoxy-2'-fluoro modified nucleotides located at the 5'-end, while another strand has at least two consecutive 2'-O-methyl modified nucleotides located at the 5'-end. In some embodiments, where the strand has at least two consecutive 2'-deoxy-2'-fluoro modified nucleotides located at the 5'-end, the strand also includes at least two, at least three consecutive 2'-O-methyl modified nucleotides at the 3'end of the at least two consecutive 2'-deoxy-2'-fluoro modified nucleotides. In some embodiments, one of sense strand and antisense strand has at least two, at least three, at least four, at least five, at least six, or at least seven consecutive 2'-O-methyl modified nucleotides that are linked to a 2'-deoxy-2'-fluoro modified nucleotide on its 5'-end and/or 3'end. In some embodiments, one of sense strand and antisense strand has at least four, at least five nucleotides that have alternating 2'-O-methyl modified nucleotide and 2'-deoxy-2'-fluoro modified nucleotide.

In some embodiments, the oligonucleotide molecule, such as a siRNA, has the formula as illustrated in Formula I:

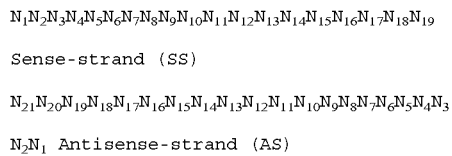

$N_1N_2N_3N_4N_5N_6N_7N_8N_9N_{10}N_{11}N_{12}N_{13}N_{14}N_{15}N_{16}N_{17}N_{18}N_{19}$

Sense-strand (SS)

$N_{21}N_{20}N_{19}N_{18}N_{17}N_{16}N_{15}N_{14}N_{13}N_{12}N_{11}N_{10}N_9N_8N_7N_6N_5N_4N_3$ $N_2N_1$ Antisense-strand (AS)

wherein each nucleotide represented by N, is independently, A, U, C, or G or a modified nucleotide base, such as those provided for herein. The $N_1$ nucleotides of the sense strand and the antisense strand represent the 5' end of the respective strands. For clarity, although Formula I utilizes $N_1$, $N_2$, $N_3$, etc. in both the sense and the antisense strand, the nucleotide bases do not need to be the same and are not intended to be the same. The siRNA that is illustrated in Formula I would be complementary to a target sequence.

For example, in some embodiments, the sense strand comprises a 2'O-methyl modified nucleotide with a phosphorothioate (PS) modified backbone at $N_1$ and $N_2$, a 2'-fluoro modified nucleotide at $N_3$, $N_7$, $N_8$, $N_9$, $N_{12}$, and $N_{17}$, and a 2'O-methyl modified nucleotide at $N_4$, $N_5$, $N_6$, $N_{10}$, $N_{11}$, $N_{13}$, $N_{14}$, $N_{15}$, $N_{16}$, $N_{18}$, and $N_{19}$.

In some embodiments, the antisense strand comprises a vinylphosphonate moiety attached to $N_1$, a 2'fluoro-modified nucleotide with a phosphorothioate (PS) modified backbone at $N_2$, a 2'O-methyl modified nucleotide at $N_3$, $N_4$, $N_5$, $N_6$, $N_7$, $N_8$, $N_9$, $N_{10}$, $N_{11}$, $N_{12}$, $N_{13}$, $N_{15}$, $N_{16}$, $N_{17}$, $N_{18}$, and $N_{19}$, a 2'fluoro-modified nucleotide at $N_{14}$, and a 2'O-methyl modified nucleotide with a phosphorothioate (PS) modified backbone at $N_{20}$ and $N_{21}$.

In some embodiments, an oligonucleotide molecule comprises a sense strand and antisense strand, wherein the sense strand includes a terminal cap moiety at the 5'-end, the 3'-end, or both of the 5' and 3' ends of the sense strand. In other embodiments, the terminal cap moiety is an inverted deoxy abasic moiety.

In some embodiments, an oligonucleotide molecule comprises a sense strand and an antisense strand, wherein the antisense strand comprises a glyceryl modification at the 3' end of the antisense strand.

In some embodiments, an oligonucleotide molecule comprises a sense strand and an antisense strand, in which the sense strand comprises one or more, for example, about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or about one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and in which the antisense strand comprises about 1 to about 10 or more, specifically about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more, for example about 1, 2, 3, 4, 5, 6, 7, 8, 9, 10, or more, pyrimidine nucleotides of the sense and/or antisense strand are chemically-modified with 2'-deoxy, 2'-O-methyl and/or 2'-deoxy-2'-fluoro nucleotides, with or without one or more, for example about 1, 2, 3, 4, 5, 6, 7, 8, 9, 10, or more, phosphorothioate, phosphorodithioate, phosphonate, phosphoramidate, or mesyl phosphoramidate internucleotide linkages and/or a terminal cap molecule at the 3'-end, the 5'-end, or both of the 3'- and 5'-ends, being present in the same or different strand.

In some embodiments, an oligonucleotide molecule comprises a sense strand and an antisense strand, in which the sense strand comprises about 1 to about 25, for example, about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10, or more) 2'-deoxy, 2'-O-methyl, 2'-deoxy-2'-fluoro, and/or one or more (e.g., about 1, 2, 3, 4, 5, 6, 7, 8, 9, 10, or more) universal base modified nucleotides, and optionally a terminal cap molecule at the 3-end, the 5'-end, or both of the 3'- and 5'-ends of the sense strand; and in which the antisense strand comprises about 1 to about 25 or more, for example about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more, for example about 1, 2, 3, 4, 5, 6, 7, 8, 9, 10, or more, pyrimidine nucleotides of the sense and/or antisense strand are chemically-modified with 2'-deoxy, 2'-O-methyl and/or 2'-deoxy-2'-fluoro nucleotides, with or without about 1 to about 25 or more, for example about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages and/or a terminal cap molecule at the 3'-end, the 5'-end, or both of the 3'- and 5'-ends, being present in the same or different strand.

In some embodiments, an oligonucleotide molecule comprises a sense strand and an antisense strand, in which the antisense strand comprises one or more, for example, about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or about one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides at the 3'-end, the 5'-end, or both of the 3'- and 5'-ends of the sense strand and/or antisense strand, and optionally a terminal cap molecule at the 3'-end, the 5'-end, or both of the 3'- and 5'-ends of the sense strand. In some embodiments, the antisense strand comprises about 1 to about 10 or more, specifically about 1, 2, 3, 4, 5, 6, 7, 8, 9, 10 or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more, for example about 1, 2, 3, 4, 5, 6, 7, 8, 9, 10, 11, 12, 13, 14, 15, 16, 17, 18, 19, 20, or more pyrimidine nucleotides of the sense and/or antisense strand are chemically-modified with 2'-deoxy, 2'-O-methyl and/or 2'-deoxy-2'-fluoro nucleotides, with or without one or more, for example, about 1, 2, 3, 4, 5, 6, 7, 8, 9, 10 or more phosphorothioate, phosphorodithioate, phosphonate, phosphoramidate, or mesyl phosphoramidate internucleotide linkages and/or a terminal cap molecule at the 3'-end, the 5'-end, or both of the 3' and 5'-ends, being present in the same or different strand.

In some embodiments, an oligonucleotide molecule comprises a sense strand and an antisense strand, in which the antisense strand comprises about 1 to about 25 or more, for example, about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the sense strand; and the antisense strand comprises about 1 to about 25 or more, for example about 1, 2, 3, 4, 5, 6, 7, 8, 9, 10, 11, 12, 13, 14, 15, 16, 17, 18, 19, 20, or more phosphorothioate, phosphorodithioate, phosphonate, phosphoramidate, or mesyl phosphoramidate internucleotide linkages, and/or one or more (e.g., about 1, 2, 3, 4, 5, 6, 7, 8, 9, 10 or more) 2'-deoxy, 2'-O-methyl, 2'-deoxy-2'-fluoro, and/or one or more (e.g., about 1, 2, 3, 4, 5, 6, 7, 8, 9, 10 or more) universal base modified nucleotides, and optionally a terminal cap molecule at the 3'-end, the 5'-end, or both of the 3'- and 5'-ends of the antisense strand. In other embodiments, one or more, for example about 1, 2, 3, 4, 5, 6, 7, 8, 9, 10 or more pyrimidine nucleotides of the sense and/or antisense strand are chemically-modified with 2'-deoxy, 2'-O-methyl and/or 2'-deoxy-2'-fluoro nucleotides, with or without about 1 to about 5, for example about 1, 2, 3, 4, 5 or more phosphorothioate, phosphorodithioate, phosphonate, phosphoramidate, or mesyl phosphoramidate internucleotide linkages and/or a terminal cap molecule at the 3'-end, the 5'-end, or both of the 3'- and 5'-ends, being present in the same or different strand.

In some embodiments, an oligonucleotide molecule described herein is a chemically-modified short interfering nucleic acid molecule having about 1 to about 25, for example, about 1, 2, 3, 4, 5, 6, 7, 8, 9, 10, 11, 12, 13, 14, 15, 16, 17, 18, 19, 20 or more phosphorothioate, phosphorodithioate, phosphonate, phosphoramidate, or mesyl phosphoramidate internucleotide linkages in each strand of the oligonucleotide molecule. In some embodiments, an oligonucleotide molecule comprises a sense strand and an antisense strand, and the antisense strand comprises a phosphate backbone modification at the 3' end of the antisense strand. Alternatively and/or additionally, an oligonucleotide molecule comprises a sense strand and an antisense strand, and the sense strand comprises a phosphate backbone modification at the 5' end of the antisense strand. In some instances, the phosphate backbone modification is a phosphorothioate. In some instances, the phosphate backbone modification is a phosphorodithioate. In some instances, the phosphate backbone modification is a phosphonate. In some instances, the phosphate backbone modification is a phosphoramidate. In some instances, the phosphate backbone modification is a mesyl phosphoramidate. In some embodiments, the sense or antisense strand has three consecutive nucleosides that are coupled via two phosphorothioate backbone. In some embodiments, the sense or antisense strand has three consecutive nucleosides that are coupled via two phosphorodithioate backbone. In some embodiments, the sense or antisense strand has three consecutive nucleosides that are coupled via two phosphonate backbone. In some embodiments, the sense or antisense strand has three consecutive nucleosides that are coupled via two phosphoramidate backbone. In some embodiments, the sense or antisense strand has three consecutive nucleosides that are coupled via two mesyl phosphoramidate backbone.

In another embodiment, an oligonucleotide molecule described herein comprises 2'-5' internucleotide linkages. In some instances, the 2'-5' internucleotide linkage(s) is at the 3'-end, the 5'-end, or both of the 3'- and 5'-ends of one or both sequence strands. In addition instances, the 2'-5' internucleotide linkage(s) is present at various other positions within one or both sequence strands, for example, about 1, 2, 3, 4, 5, 6, 7, 8, 9, 10, or more including every internucleotide linkage of a pyrimidine nucleotide in one or both strands of the oligonucleotide molecule comprise a 2'-5' internucleotide linkage, or about 1, 2, 3, 4, 5, 6, 7, 8, 9, 10, or more including every internucleotide linkage of a purine nucleotide in one or both strands of the oligonucleotide molecule comprise a 2'-5' internucleotide linkage.

In some embodiments, an oligonucleotide molecule is a single stranded molecule that mediates RNAi activity in a cell or reconstituted in vitro system, wherein the oligonucleotide molecule comprises a single stranded polynucleotide having complementarity to a target nucleic acid sequence, and wherein one or more pyrimidine nucleotides present in the oligonucleotide molecule are 2'-deoxy-2'-fluoro pyrimidine nucleotides (e.g., wherein all pyrimidine nucleotides are 2'-deoxy-2'-fluoro pyrimidine nucleotides or alternately a plurality of pyrimidine nucleotides are 2'-deoxy-2'-fluoro pyrimidine nucleotides), and wherein any purine nucleotides present in the oligonucleotide molecule are 2'-deoxy purine nucleotides (e.g., wherein all purinenucleotides are 2'-deoxy purine nucleotides or alternately a plurality of purine nucleotides are 2'-deoxy purine nucleotides), and a terminal cap modification, that is optionally present at the 3'-end, the 5'-end, or both of the 3' and 5'-ends of the antisense sequence, the oligonucleotide molecule optionally further comprising about 1 to about 4 (e.g., about 1, 2, 3, or 4) terminal 2'-deoxynucleotides at the 3'-end of the oligonucleotide molecule, wherein the terminal nucleotides further comprise one or more (e.g., 1, 2, 3, or 4) phosphorothioate or mesyl phosphoramidate internucleotide linkages, and wherein the oligonucleotide molecule optionally further comprises a terminal phosphate group, such as a 5'-terminal phosphate group.

In some cases, one or more of the synthetic nucleotide analogues described herein are resistant toward nucleases such as for example ribonuclease such as RNase H, deoxyribonuclease such as DNase, or exonuclease such as 5'-3' exonuclease and 3'-5' exonuclease when compared to natural polynucleic acid molecules and endonucleases. In some instances, synthetic nucleotide analogues comprising 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA) modified, LNA, ENA, PNA, HNA, morpholino, methylphosphonate nucleotides, thiolphosphonate nucleotides, 2'-fluoro N3-P5'-phosphoramidites, or combinations thereof are resistant toward nucleases such as for example ribonuclease such as RNase H, deoxyribonuclease such as DNase, or exonuclease such as 5'-3' exonuclease and 3'-5' exonuclease. In some instances, 2'-O-methyl modified oligonucleotide molecule is nuclease resistance (e.g., RNase H, DNase, 5'-3' exonuclease or 3'-5' exonuclease resistance). In some instances, 2'O-methoxyethyl (2'-O-MOE) modified oligonucleotide molecule is nuclease resistance (e.g., RNase H, DNase, 5'-3' exonuclease or 3'-5' exonuclease resistance). In some instances, 2'-O-aminopropyl modified oligonucleotide molecule is nuclease resistance (e.g., RNase H, DNase, 5'-3' exonuclease or 3'-5' exonuclease resistance). In some instances, 2'-deoxy modified oligonucleotide molecule is nuclease resistance (e.g., RNase H, DNase, 5'-3' exonuclease or 3'-5' exonuclease resistance). In some instances, 2'-deoxy-2'-fluoro modified oligonucleotide molecule is nuclease resistance (e.g., RNase H, DNase, 5'-3' exonuclease or 3'-5' exonuclease resistance). In some instances, 2'-O-aminopropyl (2'-O-AP) modified oligonucleotide molecule is nuclease resistance (e.g., RNase H, DNase, 5'-3' exonuclease or 3'-5' exonuclease resistance). In some instances, 2'-O-dimethylaminoethyl (2'-O-DMAOE) modified oligonucleotide molecule is nuclease resistance (e.g., RNase H, DNase, 5'-3' exonuclease or 3'-5' exonuclease resistance). In some instances, 2'-O-dimethylaminopropyl (2'-O-DMAP) modified oligonucleotide molecule is nuclease resistance (e.g., RNase H, DNase, 5'-3' exonuclease or 3'-5' exonuclease resistance). In some instances, 2'-O-dimethylaminoethyloxyethyl (2'-O-DMAEOE) modified oligonucleotide molecule is nuclease resistance (e.g., RNase H, DNase, 5'-3' exonuclease or 3'-5' exonuclease resistance). In some instances, 2'-O-N-methylacetamido (2'-O-NMA) modified oligonucleotide molecule is nuclease resistance (e.g., RNase H, DNase, 5'-3' exonuclease or 3'-5' exonuclease resistance). In some instances, LNA modified oligonucleotide molecule is nuclease resistance (e.g., RNase H, DNase, 5'-3' exonuclease or 3'-5' exonuclease resistance). In some instances, ENA modified oligonucleotide molecule is nuclease resistance (e.g., RNase H, DNase, 5'-3' exonuclease or 3'-5' exonuclease resistance). In some instances, HNA modified oligonucleotide molecule is nuclease resistance (e.g., RNase H, DNase, 5'-3' exonuclease or 3'-5' exonuclease resistance). In some instances, morpholinos is nuclease resistance (e.g., RNase H, DNase, 5'-3' exonuclease or 3'-5' exonuclease resistance). In some instances, PNA modified oligonucleotide molecule is resistant to nucleases (e.g., RNase H, DNase, 5'-3' exonuclease or 3'-5' exonuclease resistance). In some instances, methylphosphonate nucleotides modified oligonucleotide molecule is nuclease resistance (e.g., RNase H, DNase, 5'-3' exonuclease or 3'-5' exonuclease resistance). In some instances, thiolphosphonate nucleotides modified oligonucleotide molecule is nuclease resistance (e.g., RNase H, DNase, 5'-3' exonuclease or 3'-5' exonuclease resistance). In some instances, oligonucleotide molecule comprising 2'-fluoro N3-P5'-phosphoramidites is nuclease resistance (e.g., RNase H, DNase, 5'-3' exonuclease or 3'-5' exonuclease resistance). In some instances, the 5' conjugates described herein inhibit 5'-3' exonucleolytic cleavage. In some instances, the 3' conjugates described herein inhibit 3'-5' exonucleolytic cleavage.

In some embodiments, one or more of the synthetic nucleotide analogues described herein have increased binding affinity toward their mRNA target relative to an equivalent natural polynucleic acid molecule. The one or more of the synthetic nucleotide analogues comprising 2'-O-methyl, 2'-O-methoxyethyl (2'-O-MOE), 2'-O-aminopropyl, 2'-deoxy, 2'-deoxy-2'-fluoro, 2'-O-aminopropyl (2'-0-AP), 2'-O-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA) modified, LNA, ENA, PNA, HNA, morpholino, methylphosphonate nucleotides, thiolphosphonate nucleotides, or 2'-fluoro N3-P5'-phosphoramidites have increased binding affinity toward their mRNA target relative to an equivalent natural polynucleic acid molecule. In some instances, 2'-O-methyl modified oligonucleotide molecule has increased binding affinity toward their mRNA target relative to an equivalent natural polynucleic acid molecule. In some instances, 2'-O-methoxyethyl (2'-O-MOE) modified oligonucleotide molecule has increased binding affinity toward their mRNA target relative to an equivalent natural polynucleic acid molecule. In some instances, 2'-O-aminopropyl modified oligonucleotide molecule has increased binding affinity toward their mRNA target relative to an equivalent natural polynucleic acid molecule. In some instances, 2'-deoxy modified oligonucleotide molecule has increased binding affinity toward their mRNA target relative to an equivalent natural polynucleic acid molecule. In some instances, 2'-deoxy-2'-fluoro modified oligonucleotide molecule has increased binding affinity toward their mRNA target relative to an equivalent natural polynucleic acid molecule. In some instances, 2'-O-aminopropyl (2'-O-AP) modified oligonucleotide molecule has increased binding affinity toward their mRNA target relative to an equivalent natural polynucleic acid molecule. In some instances, 2'-O-dimethylaminoethyl (2'-O-DMAOE) modified oligonucleotide molecule has increased binding affinity toward their mRNA target relative to an equivalent natural polynucleic acid molecule. In some instances, 2'-O-dimethylaminopropyl (2'-O-DMAP) modified oligonucleotide molecule has increased binding affinity toward their mRNA target relative to an equivalent natural polynucleic acid molecule. In some instances, 2'-O-dimethylaminoethyloxyethyl (2'-O-DMAEOE) modified oligonucleotide molecule has increased binding affinity toward their mRNA target relative to an equivalent natural polynucleic acid molecule. In some instances, 2'-O-N-methylacetamido (2'-O-NMA) modified oligonucleotide molecule has increased binding affinity toward their mRNA target relative to an equivalent natural polynucleic acid molecule. In some instances, LNA modified oligonucleotide molecule has increased binding affinity toward their mRNA target relative to an equivalent natural polynucleic acid molecule. In some instances, ENA modified oligonucleotide molecule has increased binding affinity toward their mRNA target relative to an equivalent natural polynucleic acid molecule. In some instances, PNA modified oligonucleotide molecule has increased binding affinity toward their mRNA target relative to an equivalent natural polynucleic acid molecule. In some instances, HNA modified oligonucleotide molecule has increased binding affinity toward their mRNA target relative to an equivalent natural polynucleic acid molecule. In some instances, morpholino modified oligonucleotide molecule has increased binding affinity toward their mRNA target relative to an equivalent natural polynucleic acid molecule. In some instances, methylphosphonate nucleotides modified oligonucleotide molecule has increased binding affinity toward their mRNA target relative to an equivalent natural polynucleic acid molecule. In some instances, thiolphosphonate nucleotides modified oligonucleotide molecule has increased binding affinity toward their mRNA target relative to an equivalent natural polynucleic acid molecule. In some instances, oligonucleotide molecule comprising 2'-fluoro N3-P5'-phosphoramidites has increased binding affinity toward their mRNA target relative to an equivalent natural polynucleic acid molecule. In some cases, the increased affinity is illustrated with a lower Kd, a higher melt temperature (Tm), or a combination thereof.

In some embodiments, an oligonucleotide molecule described herein is a chirally pure (or stereo pure) polynucleic acid molecule, or a polynucleic acid molecule comprising a single enantiomer. In some instances, the oligonucleotide molecule comprises L-nucleotide. In some instances, the oligonucleotide molecule comprises D-nucleotides. In some instance, an oligonucleotide molecule composition comprises less than 30%, 25%, 20%, 15%, 10%, 5%, 4%, 3%, 2%, 1%, or less of its mirror enantiomer. In some cases, an oligonucleotide molecule composition comprises less than 30%, 25%, 20%, 15%, 10%, 5%, 4%, 3%, 2%, 1%, or less of a racemic mixture.

In some embodiments, an oligonucleotide molecule described herein is further modified to include an aptamer conjugating moiety. In some instances, the aptamer conjugating moiety is a DNA aptamer conjugating moiety. In some instances, the aptamer conjugating moiety is Alphamer, which comprises an aptamer portion that recognizes a specific cell-surface target and a portion that presents a specific epitopes for attaching to circulating antibodies.

In additional embodiments, an oligonucleotide molecule described herein is modified to increase its stability. In some embodiment, the oligonucleotide molecule is RNA (e.g., siRNA). In some instances, the oligonucleotide molecule is modified by one or more of the modifications described above to increase its stability. In some cases, the oligonucleotide molecule is modified at the 2' hydroxyl position, such as by 2'-O-methyl, 2'-O-methoxyethyl (2'-O-MOE), 2'-O-aminopropyl, 2'-deoxy, 2'-deoxy-2'-fluoro, 2'-O-aminopropyl (2'-O-AP), 2'-0-dimethylaminoethyl (2'-O-DMAOE), 2'-O-dimethylaminopropyl (2'-O-DMAP), 2'-O-dimethylaminoethyloxyethyl (2'-O-DMAEOE), or 2'-O-N-methylacetamido (2'-O-NMA) modification or by a locked or bridged ribose conformation (e.g., LNA or ENA). In some cases, the oligonucleotide molecule is modified by 2'-O-methyl and/or 2'-O-methoxyethyl ribose. In some cases, the oligonucleotide molecule also includes morpholinos, PNAs, HNA, methylphosphonate nucleotides, thiolphosphonate nucleotides, and/or 2'-fluoro N3-P5'-phosphoramidites to increase its stability. In some instances, the oligonucleotide molecule is a chirally pure (or stereo pure) oligonucleotide molecule. In some instances, the chirally pure (orstereo pure) oligonucleotide molecule is modified to increase its stability. Suitable modifications to the RNA to increase stability for delivery will be apparent to the skilled person.

In some embodiments, the oligonucleotide molecule comprises 2' modifications. In some embodiments, the nucleotides of the oligonucleotide molecule at positions 3, 7, 8, 9, 12, and 17 from the 5' end of the sense strand are not modified with a 2'O-methyl modification. In some embodiments, the nucleotides of the oligonucleotide molecule at positions 3, 7, 8, 9, 12, and 17 from the 5' end of the sense strand are modified with a 2'fluoro modification. In some embodiments, the nucleotides of the oligonucleotide molecule at positions 2 and 14 from the 5' end of the anti-sense strand are not modified with a 2'O-methyl modification. In some embodiments, the nucleotides of the oligonucleotide molecule at positions 2 and 14 from the 5' end of the anti-sense strand are modified with a 2'fluoro modification. In some embodiments, any of the nucleotides may further comprise a 5'-phosphorothioate group modification. In some embodiments, the nucleotides of the oligonucleotide molecule at positions 1 and 2 from the 5' end of the sense strand are modified with a 5'-phosphorothioate group modification. In some embodiments, the nucleotides of the oligonucleotide molecule at positions 1, 2, 20, and 21 from the 5' end of the antisense strand are modified with a 5'-phosphorothioate group modification. In some embodiments, the 5' end of the sense or antisense strand of the oligonucleotide molecule may further comprise a vinylphosphonate modification. In some embodiments, the nucleotide of the oligonucleotide molecule at position 1 from the 5' end of the antisense strand is modified with a vinylphosphonate modification.

In some instances, the oligonucleotide molecule is a double-stranded polynucleotide molecule comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof. In some instances, the oligonucleotide molecule is assembled from two separate polynucleotides, where one strand is the sense strand and the other is the antisense strand, wherein the antisense and sense strands are self-complementary (e.g., each strand comprises nucleotide sequence that is complementary to nucleotide sequence in the other strand; such as where the antisense strand and sense strand form a duplex or double stranded structure, for example wherein the double stranded region is about 19, 20, 21, 22, 23, or more base pairs); the antisense strand comprises nucleotide sequence that is complementary to nucleotide sequence in a target nucleic acid molecule or a portion thereof and the sense strand comprises nucleotide sequence corresponding to the target nucleic acid sequence or a portion thereof. Alternatively, the oligonucleotide molecule is assembled from a single oligonucleotide, where the self-complementary sense and antisense regions of the oligonucleotide molecule are linked by means of a nucleic acid based or non-nucleic acid-based linker(s).

In some cases, the oligonucleotide molecule is a polynucleotide with a duplex, asymmetric duplex, hairpin or asymmetric hairpin secondary structure, having self-complementary sense and antisense regions, wherein the antisense region comprises nucleotide sequence that is complementary to nucleotide sequence in a separate target nucleic acid molecule or a portion thereof and the sense region having nucleotide sequence corresponding to the target nucleic acid sequence or a portion thereof. In other cases, the oligonucleotide molecule is a circular single-stranded polynucleotide having two or more loop structures and a stem comprising self-complementary sense and antisense regions, wherein the antisense region comprises nucleotide sequence that is complementary to nucleotide sequence in a target nucleic acid molecule or a portion thereof and the sense region having nucleotide sequence corresponding to the target nucleic acid sequence or a portion thereof, and wherein the circular polynucleotide is processed either in vivo or in vitro to generate an active oligonucleotide molecule capable of mediating RNAi. In additional cases, the oligonucleotide molecule also comprises a single-stranded polynucleotide having nucleotide sequence complementary to nucleotide sequence in a target nucleic acid molecule or a portion thereof (for example, where such oligonucleotide molecule does not require the presence within the oligonucleotide molecule of nucleotide sequence corresponding to the target nucleic acid sequence or a portion thereof), wherein the single stranded polynucleotide further comprises a terminal phosphate group, such as a 5'-phosphate, or 5', 3'-diphosphate.

In some instances, an asymmetric hairpin is a linear oligonucleotide molecule comprising an antisense region, a loop portion that comprises nucleotides or non-nucleotides, and a sense region that comprises fewer nucleotides than the antisense region to the extent that the sense region has enough complimentary nucleotides to base pair with the antisense region and form a duplex with loop. For example, an asymmetric hairpin oligonucleotide molecule comprises an antisense region having length sufficient to mediate RNAi in a cell or in vitro system (e.g., about 19 to about 22 nucleotides) and a loop region comprising about 4 to about 8 nucleotides, and a sense region having about 3 to about 18 nucleotides that are complementary to the antisense region. In some cases, the asymmetric hairpin oligonucleotide molecule also comprises a 5'-terminal phosphate group that is chemically modified. In additional cases, the loop portion of the asymmetric hairpin oligonucleotide molecule comprises nucleotides, non-nucleotides, linker molecules, or conjugate molecules.

In some embodiments, an asymmetric duplex is an oligonucleotide molecule having two separate strands comprising a sense region and an antisense region, wherein the sense region comprises fewer nucleotides than the antisense region to the extent that the sense region has enough complimentary nucleotides to base pair with the antisense region and form a duplex. For example, an asymmetric duplex oligonucleotide molecule comprises an antisense region having length sufficient to mediate RNAi in a cell or in vitro system (e.g., about 19 to about 22 nucleotides) and a sense region having about 3 to about 19 nucleotides that are complementary to the antisense region.

In some cases, a universal base refers to nucleotide base analogs that form base pairs with each of the natural DNA/RNA bases with little discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art.

In some embodiments, the dsRNA agents are 5' phosphorylated or include a phosphoryl analog at the 5' prime terminus. 5'-phosphate modifications include those which are compatible with RISC mediated gene silencing. Suitable modifications include: 5'-monophosphate ((HO$_2$(O)P—O-5'); 5'-diphosphate ((HO)$_2$(O)P—O-P(HO)(O)-O-5'); 5'-triphosphate ((HO)$_2$(O)P-O—(HO)(O)P—O-P(HO)(O)-O-5'); 5'-guanosine cap (7-methylated or non-methylated) (7m-G-O-5'-(HO)(O)P-O—(HO)(O)P—O-P(HO)(O)-O-5'); 5'-adenosine cap (Appp), and any modified or unmodified nucleotide cap structure (N—O-5'-(HO)(O)P—O—(HO)(O)P—O—P(HO)(O)—O-5'); 5'-monothiophosphate (phosphorothioate; (HO)$_2$(S)P—O-5'); 5'-monodithiophosphate (phosphorodithioate; (HO)(HS)(S)P—O-5'), 5'-phosphorothiolate ((HO)2(O)P—S-5'); phosphorodithioate [—O$_2$PS$_2$—]; phosphonate [—PO(OH)$_2$—]; phosphoramidate [—O=P(OH)$_2$—]; mesyl phosphoramidate (CH$_3$)(SO$_2$)(N)P(O)$_2$—O-5'); any additional combination of oxygen/sulfur replaced monophosphate, diphosphate and triphosphates (e.g. 5'-alpha-thiotriphosphate, 5'-gamma-thiotriphosphate, etc.), 5'-phosphoramidates ((HO)$_2$(O)P—NH-5', (HO)(NH$_2$)(O)P-O-5'), 5'-alkylphosphonates (R=alkyl=methyl, ethyl, isopropyl, propyl, etc., e.g. RP(OH)(O)-O-5'-, 5'-alkenylphosphonates (i.e. vinyl, substituted vinyl), (OH)$_2$(O)P-5'-CH2-), 5'-alkyletherphosphonates (R=alkylether=methoxymethyl (MeOCH2-), ethoxymethyl, etc., e.g. RP(OH)(O)-O-5'-). In some embodiments, the modification can in placed in the antisense strand of a dsRNA agent.

In some embodiments, the sequence of the oligonucleotide molecule is at least 40%, 50%, 55%, 60%, 65%, 70%, 75%, 80%, 85%, 90%, 95%, 98%, 99%, or 99.5% complementary to a target sequence of GYS1. In some embodiments, the target sequence of GYS1 is a nucleic acid sequence of about 10-50 base pair length, about 15-50 base pair length, 15-40 base pair length, 15-30 base pair length, or 15-25 base pair length sequences in GYS1, in which the first nucleotide of the target sequence starts at any nucleotide in GYS1 mRNA transcript in the coding region, or in the 5' or 3'-untranslated region (UTR). For example, the first nucleotide of the target sequence can be selected so that it starts at the nucleic acid location (nal, number starting from the 5'-end of the full length of GYS1 mRNA, e.g., the 5'-end first nucleotide is nal.1) 1, nal 2, nal 3, nal 4, nal 5, nal 6, nal 7, nal 8, nal 9, nal 10, nal 11, nal 12, nal 13, nal 14, nal 15, nal 15, nal 16, nal 17, or any other nucleic acid location in the coding or noncoding regions (5' or 3'-untranslated region) of GYS1 mRNA. In some embodiments, the first nucleotide of the target sequence can be selected so that it starts at a location within, or between, nal 10- nal 15, nal 10- nal 20, nal 50- nal 60, nal 55- nal 65, nal 75- nal 85, nal 95- nal 105, nal 135- nal 145, nal 155- nal 165, nal 225- nal 235, nal 265- nal 275, nal 275- nal 245, nal 245- nal 255, nal 285- nal 335, nal 335- nal 345, nal 385- nal 395, nal 515- nal 525, nal 665- nal 675, nal 675- nal 685, nal 695- nal 705, nal 705- nal 715, nal 875- nal 885, nal 885- nal 895, nal 895- nal 905, nal 1035- nal 1045, nal 1045- nal 1055, nal 1125- nal 1135, nal 1135- nal 1145, nal 1145-nal 1155, nal 1155- nal 1165, nal 1125- nal 1135, nal 1155- nal 1165, nal 1225- nal 1235, nal 1235- nal 1245, nal 1275- nal 1245, nal 1245- nal 1255, nal 1265- nal 1275, nal 1125- nal 1135, nal 1155- nal 1165, nal 1225- nal 1235, nal 1235- nal 1245, nal 1275- nal 1245, nal 1245- nal 1255, nal 1265- nal 1275, nal 1275- nal 1285, nal 1335- nal 1345, nal 1345- nal 1355, nal 1525-nal 1535, nal 1535- nal 1545, nal 1605- nal 1615, nal 1615-c.1625, nal 1625- nal 1635, nal 1635-1735, nal 1735-1835, nal 1835-1935, nal. 1836-1856, nal 1935-2000, nal 2000-2100, nal 2100-2200, nal 2200-2260, nal 2260-2400, nal 2400-2500, nal 2500-2600, nal 2600-2700, nal 2700-2800, nal 2800-2500, nal 2500-2600, nal 2600-2700, nal 2700-2800, nal 2800-2860, etc. In some embodiments, the sequence of GYS1 mRNA is provided as NCBI Reference Sequence: NM 002103.

In some embodiments, the antisense strand of the dsRNA agent is 100% complementary to a target RNA to hybridize thereto and inhibits its expression through RNA interference. The target RNA can be any RNA expressed in a cell. In another embodiment, the cell is a tumor cell, a liver cell, a muscle cell, an immune cell, a dendritic cell, a heart cell, or a cell of the central nervous system. In another embodiment, the antisense strand of the dsRNA agent is at least 99%, at least 98%, at least 97%, at least 96%, 95%, at least 90%, at least 85%, at least 80%, at least 75%, at least 70%, at least 65%, at least 60%, at least 55%, or at least 50% complementary to a target RNA. In some embodiments, the target RNA is GYS1 RNA. In some embodiments, the siRNA molecule is a siRNA that reduces the expression of GYS1. In some embodiments, the siRNA molecule is a siRNA that reduces the expression of GYS and does not reduce the expression of other RNAs by more than 50% in an assay described herein at a concentration of no more than 200 nm as described herein.

The siRNA can be targeted against any gene or RNA (e.g. mRNA) transcript of interest.

Other modifications and patterns of modifications can be found in, for example, U.S. Pat. No. 10,233,448, which is hereby incorporated by reference.

Other modifications and patterns of modifications can be found in, for example, Anderson et al. Nucleic Acids Research 2021, 49 (16), 9026-9041, which is hereby incorporated by reference.

Other modifications and patterns of modifications can be found in, for example, PCT Publication No. WO2021/030778, which is hereby incorporated by reference.

Other modifications and patterns of modifications can be found in, for example, PCT Publication No. WO2021/030763, which is hereby incorporated by reference.

In some embodiments, the siRNA is linked to a protein, such as a FN3 domain. The siRNA can be linked to multiple FN3 domains that bind to the same target protein or different target proteins. In some embodiments, the linker is attached to the sense strand, which is used to facilitate the linkage of the sense strand to the FN3 domain.

In some embodiments, compositions are provided herein having a formula of $(X1)_n$-$(X2)_q$-$(X3)_y$-L-X4, wherein X1 is a first FN3 domain, X2 is second FN3 domain, X3 is a third FN3 domain or half-life extender molecule, L is a linker, and X4 is a nucleic acid molecule, such as, but not limited to a siRNA molecule, wherein n, q, and y are each independently 0 or 1. In some embodiments, X1, X2, and X3 bind to different target proteins. In some embodiments, y is 0. In some embodiments, n is 1, q is 0, and y is 0. In some embodiments, n is 1, q is 1, and y is 0. In some embodiments, n is 1, q is 1, and y is 1. In some embodiments, the third FN3 domain increases the half-life of the molecule as a whole as compared to a molecule without X3. In some embodiments, the half-life extending moiety is a FN3 domain that binds to albumin. Examples of such FN3 domains include, but are not limited to, those described in U.S. Patent Application Publication No. 20170348397 and U.S. Pat. No. 9,156,887, which is hereby incorporated by reference in its entirety. The FN3 domains may incorporate other subunits for example via covalent interaction. In some embodiments, the FN3 domains further comprise a half-life extending moiety. Exemplary half-life extending moieties are albumin, albumin variants, albumin-binding proteins and/or domains, transferrin and fragments and analogues thereof, and Fc regions. Amino acid sequences of the human Fc regions are well known, and include IgG1, IgG2, IgG3, IgG4, IgM, IgA and IgE Fc regions. In some embodiments, the FN3 domains may incorporate a second FN3 domain that binds to a molecule that extends the half-life of the entire molecule, such as, but not limited to, any of the half-life extending moieties described herein. In some embodiments, the second FN3 domain binds to albumin, albumin variants, albumin-binding proteins and/or domains, and fragments and analogues thereof.

In some embodiments, compositions are provided herein having a formula of (X1)-(X2)-L-(X4), wherein X1 is a first FN3 domain, X2 is second FN3 domain, L is a linker, and X4 is a nucleic acid molecule. In some embodiments, X4 is a siRNA molecule. In some embodiments, X1 is a FN3 domain that binds to one of CD71. In some embodiments, X2 is a FN3 domain that binds to one of CD71. In some embodiments X1 and X2 do not bind to the same target protein. In some embodiments, X1 and X2 bind to the same target protein, but at different binding sites on the protein. In some embodiments, X1 and X2 bind to the same target protein. In some embodiments, X1 and X2 are FN3 domains that bind to CD71. In some embodiments, the composition does not comprise (e.g. is free of) a compound or protein that binds to ASGPR.

In some embodiments, compositions are provided herein having a formula of C-$(X1)_n$-$(X2)_q$[L-X4]-$(X3)_y$, wherein X1 is a first FN3 domain; X2 is second FN3 domain; X3 is a third FN3 domain or half-life extender molecule; L is a linker; X4 is an oligonucleotide molecule; and C is a polymer, wherein n, q, and y are each independently 0 or 1, are provided.

In some embodiments, compositions are provided herein having a formula of $(X1)_n$-$(X2)_q$[L-X4]-$(X3)_y$-C, wherein X1 is a first FN3 domain; X2 is second FN3 domain; X3 is a third FN3 domain or half-life extender molecule; L is a linker; X4 is an oligonucleotide molecule; and C is a polymer, wherein n, q, and y are each independently 0 or 1, are provided.

In some embodiments, compositions are provided herein having a formula of C-$(X1)_n$-$(X2)_q$[L-X4]L-$(X3)_y$, wherein X1 is a first FN3 domain; X2 is second FN3 domain; X3 is a third FN3 domain or half-life extender molecule; L is a linker; X4 is an oligonucleotide molecule; and C is a polymer, wherein n, q, and y are each independently 0 or 1, are provided.

In some embodiments, compositions are provided herein having a formula of $(X1)_n$-$(X2)_q$[L-X4]L-$(X3)_5$,-C, wherein X1 is a first FN3 domain; X2 is second FN3 domain; X3 is a third FN3 domain or half-life extender molecule; L is a linker; X4 is an oligonucleotide molecule; and C is a polymer, wherein n, q, and y are each independently 0 or 1, are provided.

In some embodiments, compositions or complexes are provided having a formula of $A_1$-$B_1$, wherein $A_1$ has a formula of C-$L_1$-$X_S$ and $B_1$ has a formula of $X_{AS}$-$L_2$-$F_1$, wherein:

C is a polymer, such as PEG;

$L_1$ and $L_2$ are each, independently, a linker;

$X_S$ is a 5' to 3' oligonucleotide sense strand of a double stranded siRNA molecule;

$X_{AS}$ is a 3' to 5' oligonucleotide antisense strand of a double stranded siRNA molecule;

$F_1$ is a polypeptide comprising at least one FN3 domain; wherein $X_S$ and $X_{AS}$ form a double stranded oligonucleotide molecule to form the composition/complex.

In some embodiments, C can be a molecule that extends the half-life of the molecule. Examples of such moieties are described herein. In some embodiments, C can also be Endoporter, INF-7, TAT, polyarginine, polylysine, or an amphipathic peptide. These moieties can be used in place of or in addition to other half-life extending moieties provided for herein. In some embodiments, C can be a molecule that delivers the complex into the cell, the endosome, or the ER; said molecules are selected from those peptides listed in Table 9:

| SEQ ID NO: | Name | Sequence |
|---|---|---|
| 750 | TAT | RKKRRQRRR |
| 751 | Penetratin | RQIKIWFQNRRMKWKK |
| 752 | Transportan | GWTLNSAGYLLGKINKALAALAKKIL |
| 753 | MAP | KLALKLALKALKAALKLA |
| 754 | Pep-1 | KETWWETWWTEWSQPKKKRKV |
| 755 | KDEL | KDEL |
| 756 | GALA | WEAALAEALAELAEHLAEALAEALEALAA |
| 757 | HA2 | GDIMGEWGNEIFGAIAGFLGC |
| 758 | Aurine 1.2 | GLFDIIKKIAESF |
| 759 | MPG | GALFLGWLGAAGSTMGAPKSKRKV |
| 760 | TP-10 | AGYLLGKINLKALAALAKKIL |
| 761 | EB-1 | LIRLWSHLIHIWFQNRRLKWKKK |
| 762 | HA2-Penetratin | GLFGAIAGFIENGWEGMIDGRQIKIWFQNRMKWKK |
| 763 | Endosomolytic | FFKKLAHALHLLALLALHLAHALKKA |
| 764 | Endosomolytic | LFEAIEGFIENGWEGMIDGWYG |
| 765 | Endosomolytic | LFEAIEGFIENGWEGMIDGWYGRKKRRQRRR |
| 766 | Endosomolytic | IGAVLKVLTTGLPALISWIKRKRQQ |
| 767 | ER Targeting | MKLAVTLTLVTLALSSSSASA |
| 1061 | ER Targeting | RLIEDICLPRWGCLWEDDKDEL |
| 1062 | ER Targeting | MIRTLLLSTLVAGALSK |
| 1063 | ER Targeting | ILSSLTVTQLLRRLHQWIK |
| 1064 | ER Targeting | MIRTLLLSTLVAGALSKDEL |

In some embodiments, compositions or complexes are provided having a formula of $A_1$-$B_1$, wherein $A_1$ has a formula of $X_S$ and $B_1$ has a formula of $X_{AS}$-$L_2$-$F_1$.

In some embodiments, compositions or complexes are provided having a formula of $A_1$-$B_1$, wherein $A_1$ has a formula of C-$L_1$-$X_S$ and $B_1$ has a formula of $X_{AS}$.

In some embodiments, the sense strand is a sense strand as provided for herein.

In some embodiments, the antisense strand is an antisense strand as provided for herein.

In some embodiments, the sense and antisense strand form a double stranded siRNA molecule that targets GYS1. In some embodiments, the double stranded oligonucleotide is about 21-23 nucleotides base pairs in length. In certain embodiments, C is optional.

In some embodiments, compositions or complexes are provided having a formula of $A_1$-$B_1$, wherein $A_1$ has a formula of $F_1$-$L_1$-$X_S$ and $B_1$ has a formula of $X_{AS}$-$L_2$-C, wherein: $F_1$ is a polypeptide comprising at least one FN3 domain;

$L_1$ and $L_2$ are each, independently, a linker;

C is a polymer, such as PEG;

$X_S$ is a 5' to 3' oligonucleotide sense strand of a double stranded siRNA molecule;

$X_{AS}$ is a 3' to 5' oligonucleotide antisense strand of a double stranded siRNA molecule; wherein $X_S$ and $X_{AS}$ form a double stranded oligonucleotide molecule to form the composition/complex. In certain embodiments, C is optional.

In some embodiments, compositions or complexes are provided having a formula of $A_1$-$B_1$, wherein $A_1$ has a formula of $X_S$ and $B_1$ has a formula of $X_{AS}$-$L_2$-C.

In some embodiments, compositions or complexes are provided having a formula of $A_1$-$B_1$, wherein $A_1$ has a formula of $F_1$-$L_1$-$X_S$ and $B_1$ has a formula of $X_{AS}$.

In some embodiments, C is a natural or synthetic polymer, consisting of long chains of branched or unbranched monomers, and/or cross-linked network of monomers in two or three dimensions In some instances, the polymer includes a polysaccharide, lignin, rubber, or polyalkylen oxide, which can be for example, polyethylene glycol. In some instances, the at least one polymer includes, but is not limited to, alpha-, omega-dihydroxylpolyethyleneglycol, biodegradable lactone-based polymer, e.g. polyacrylic acid, polylactide acid (PLA), poly(glycolic acid) (PGA), polypropylene, polystyrene, polyolefin, polyamide, polycyanoacrylate, polyimide, polyethylenterephthalat (PET, PETG), polyethylene -B-Bterephthalate (PETE), polytetramethylene glycol (PTG), or polyurethane as well as mixtures thereof. As used herein, a mixture refers to the use of different polymers within the same compound as well as in reference to block copolymers. In some cases, block copolymers are polymers wherein at least one section of a polymer is build up from monomers of another polymer. In some instances, the polymer comprises polyalkylene oxide. In some instances, the polymer comprises PEG. In some instances, the polymer comprises polyethylene imide (PEI) or hydroxy ethyl starch (HES).

In some embodiments, the polyalkylene oxide (e.g., PEG) is a polydispers or monodispers compound. In some instances, polydispers material comprises disperse distribution of different molecular weight of the material, characterized by mean weight (weight average) size and dispersity. In some instances, the monodisperse PEG comprises one size of molecules. In some embodiments, C is poly- or monodispersed polyalkylene oxide (e.g., PEG) and the indicated molecular weight represents an average of the molecular weight of the polyalkylene oxide, e.g., PEG, molecules.

In some embodiments, the molecular weight of the polyalkylene oxide (e.g., PEG) is about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da.

In some embodiments, C is polyalkylene oxide (e.g., PEG) and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some embodiments, C is PEG and has a molecular weight of about 200, 300, 400, 500, 600, 700, 800, 900, 1000, 1100, 1200, 1300, 1400, 1450, 1500, 1600, 1700, 1800, 1900, 2000, 2100, 2200, 2300, 2400, 2500, 2600, 2700, 2800, 2900, 3000, 3250, 3350, 3500, 3750, 4000, 4250, 4500, 4600, 4750, 5000, 5500, 6000, 6500, 7000, 7500, 8000, 10,000, 12,000, 20,000, 35,000, 40,000, 50,000, 60,000, or 100,000 Da. In some instances, the molecular weight of C is about 200 Da. In some instances, the molecular weight of C is about 300 Da. In some instances, the molecular weight of C is about 400 Da. In some instances, the molecular weight of C is about 500 Da. In some instances, the molecular weight of C is about 600 Da. In some instances, the molecular weight of C is about 700 Da. In some instances, the molecular weight of C is about 800 Da. In some instances, the molecular weight of C is about 900 Da. In some instances, the molecular weight of C is about 1000 Da. In some instances, the molecular weight of C is about 1100 Da. In some instances, the molecular weight of C is about 1200 Da. In some instances, the molecular weight of C is about 1300 Da. In some instances, the molecular weight of C is about 1400 Da. In some instances, the molecular weight of C is about 1450 Da. In some instances, the molecular weight of C is about 1500 Da. In some instances, the molecular weight of C is about 1600 Da. In some instances, the molecular weight of C is about 1700 Da. In some instances, the molecular weight of C is about 1800 Da. In some instances, the molecular weight of C is about 1900 Da. In some instances, the molecular weight of C is about 2000 Da. In some instances, the molecular weight of C is about 2100 Da. In some instances, the molecular weight of C is about 2200 Da. In some instances, the molecular weight of C is about 2300 Da. In some instances, the molecular weight of C is about 2400 Da. In some instances, the molecular weight of C is about 2500 Da. In some instances, the molecular weight of C is about 2600 Da. In some instances, the molecular weight of C is about 2700 Da. In some instances, the molecular weight of C is about 2800 Da. In some instances, the molecular weight of C is about 2900 Da. In some instances, the molecular weight of C is about 3000 Da. In some instances, the molecular weight of C is about 3250 Da. In some instances, the molecular weight of C is about 3350 Da. In some instances, the molecular weight of C is about 3500 Da. In some instances, the molecular weight of C is about 3750 Da. In some instances, the molecular weight of C is about 4000 Da. In some instances, the molecular weight of C is about 4250 Da. In some instances, the molecular weight of C is about 4500 Da. In some instances, the molecular weight of C is about 4600 Da. In some instances, the molecular weight of C is about 4750 Da. In some instances, the molecular weight of C is about 5000 Da. In some instances, the molecular weight of C is about 5500 Da. In some instances, the molecular weight of C is about 6000 Da. In some instances, the molecular weight of C is about 6500 Da. In some instances, the molecular weight of C is about 7000 Da. In some instances, the molecular weight of C is about 7500 Da. In some instances, the molecular weight of C is about 8000 Da. In some instances, the molecular weight of C is about 10,000 Da. In some instances, the molecular weight of C is about 12,000 Da. In some instances, the molecular weight of C is about 20,000 Da. In some instances, the molecular weight of C is about 35,000 Da. In some instances, the molecular weight of C is about 40,000 Da. In some instances, the molecular weight of C is about 50,000 Da. In some instances, the molecular weight of C is about 60,000 Da. In some instances, the molecular weight of C is about 100,000 Da.

In some embodiments, the polyalkylene oxide (e.g., PEG) is a discrete PEG, in which the discrete PEG is a polymeric PEG comprising more than one repeating ethylene oxide units. In some instances, a discrete PEG (dPEG) comprises from 2 to 60, from 2 to 50, or from 2 to 48 repeating ethylene oxide units. In some instances, a dPEG comprises about 2, 3, 4, 5, 6, 7, 8, 9, 10, 11, 12, 13, 14, 15, 16, 17, 18, 19, 20, 22, 24, 26, 28, 30, 35, 40, 42, 48, 50 or more repeating ethylene oxide units. In some instances, a dPEG comprises about 2 or more repeating ethylene oxide units. In some instances, a dPEG comprises about 3 or more repeating ethylene oxide units. In some instances, a dPEG comprises about 4 or more repeating ethylene oxide units. In some instances, a dPEG comprises about 5 or more repeating ethylene oxide units. In some instances, a dPEG comprises about 6 or more repeating ethylene oxide units. In some instances, a dPEG comprises about 7 or more repeating ethylene oxide units. In some instances, a dPEG comprises about 8 or more repeating ethylene oxide units. In some instances, a dPEG comprises about 9 or more repeating ethylene oxide units. In some instances, a dPEG comprises about 10 or more repeating ethylene oxide units. In some instances, a dPEG comprises about 11 or more repeating ethylene oxide units. In some instances, a dPEG comprises about 12 or more repeating ethylene oxide units. In some instances, a dPEG comprises about 13 or more repeating ethylene oxide units. In some instances, a dPEG comprises about 14 or more repeating ethylene oxide units. In some instances, a dPEG comprises about 15 or more repeating ethylene oxide units. In some instances, a dPEG comprises about 16 or more repeating ethylene oxide units. In some instances, a dPEG comprises about 17 or more repeating ethylene oxide units. In some instances, a dPEG comprises about 18 or more repeating ethylene oxide units. In some instances, a dPEG comprises about 19 or more repeating ethylene oxide units. In some instances, a dPEG comprises about 20 or more repeating ethylene oxide units. In some instances, a dPEG comprises about 22 or more repeating ethylene oxide units. In some instances, a dPEG comprises about 24 or more repeating ethylene oxide units. In some instances, a dPEG comprises about 26 or more repeating ethylene oxide units. In some instances, a dPEG comprises about 28 or more repeating ethylene oxide units. In some instances, a dPEG comprises about 30 or more repeating ethylene oxide units. In some instances, a dPEG comprises about 35 or more repeating ethylene oxide units. In some instances, a dPEG comprises about 40 or more repeating ethylene oxide units. In some instances, a dPEG comprises about 42 or more repeating ethylene oxide units. In some instances, a dPEG comprises about 48 or more repeating ethylene oxide units. In some instances, a dPEG comprises about 50 or more repeating ethylene oxide units. In some cases, a dPEG is synthesized as a single molecular weight compound from pure (e.g., about 95%, 98%, 99%, or 99.5%) staring material in a step-wise fashion. In some cases, a dPEG has a specific molecular weight, rather than an average molecular weight. In some cases, a dPEG described herein is a dPEG from Quanta Biodesign, LMD.

In some embodiments, $L_1$ is any linker that can be used to link the polymer C to the sense strand $X_S$ or to link the polypeptide of $F_1$ to the sense strand $X_S$. In some embodiments, $L_1$ has a formula of:

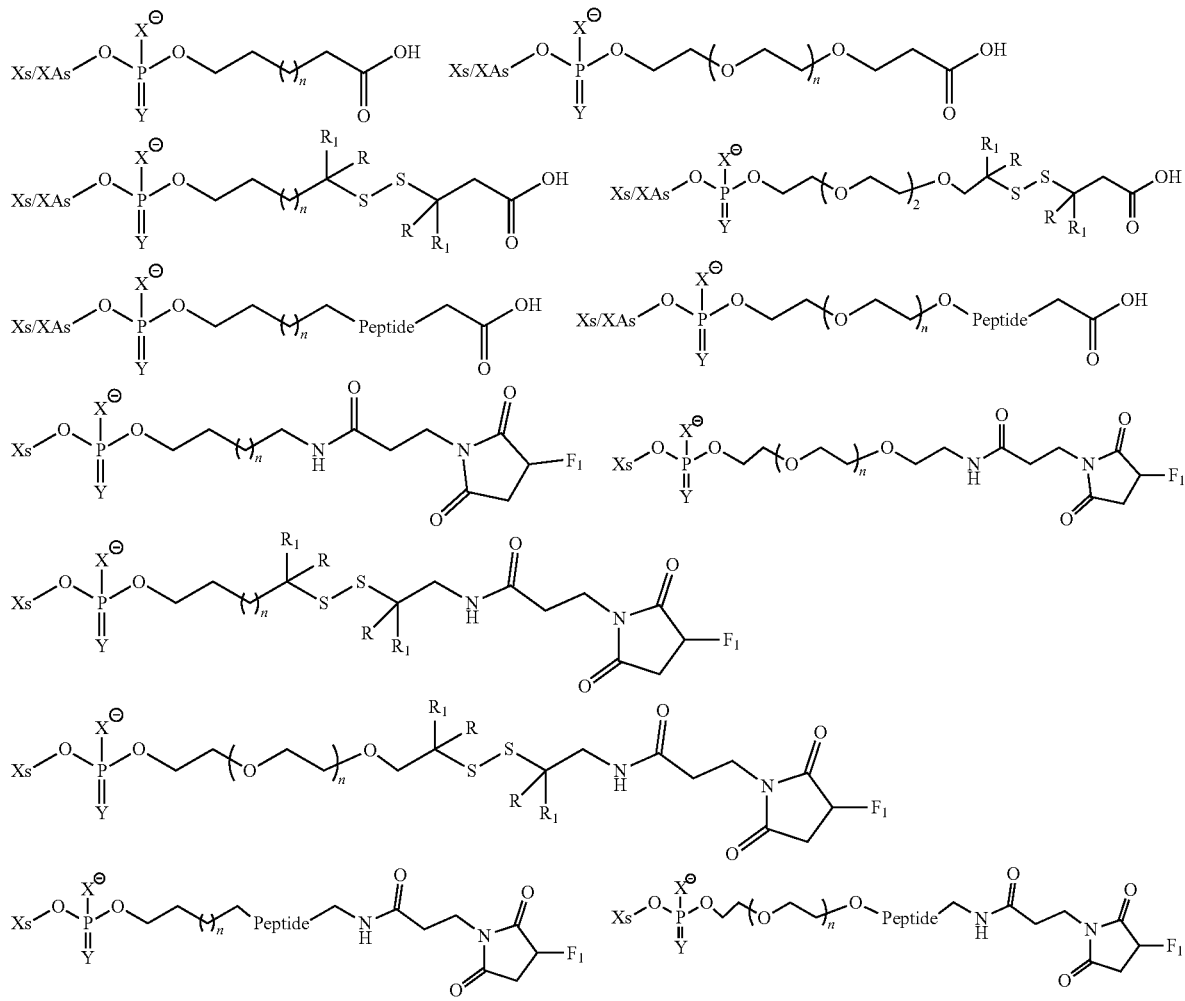

45 wherein $X_S$, $X_{AS}$, and $F_1$ are as defined above.

In some embodiments, n=0-20. In some embodiments, R and R1 are independently methyl. In some embodiments, R and R1 are independently present or both are absent. In some embodiments, X and Y are independently S. In some embodiments, X and Y are independently present or absent. In some embodiments, Peptide is an enzymatically cleavable peptide, such as, but not limited to, Val-Cit, Val-Ala etc.

In some embodiments, $L_2$ is any linker that can be used to link the polypeptide of F1 to the antisense strand $X_{AS}$ or to link the polymer C to the antisense strand $X_{AS}$.

In some embodiments, $L_2$ has a formula of in the complex of:

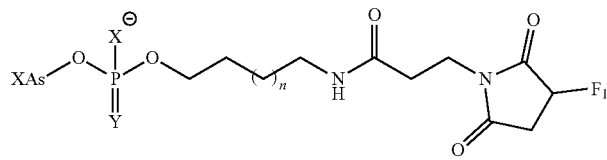

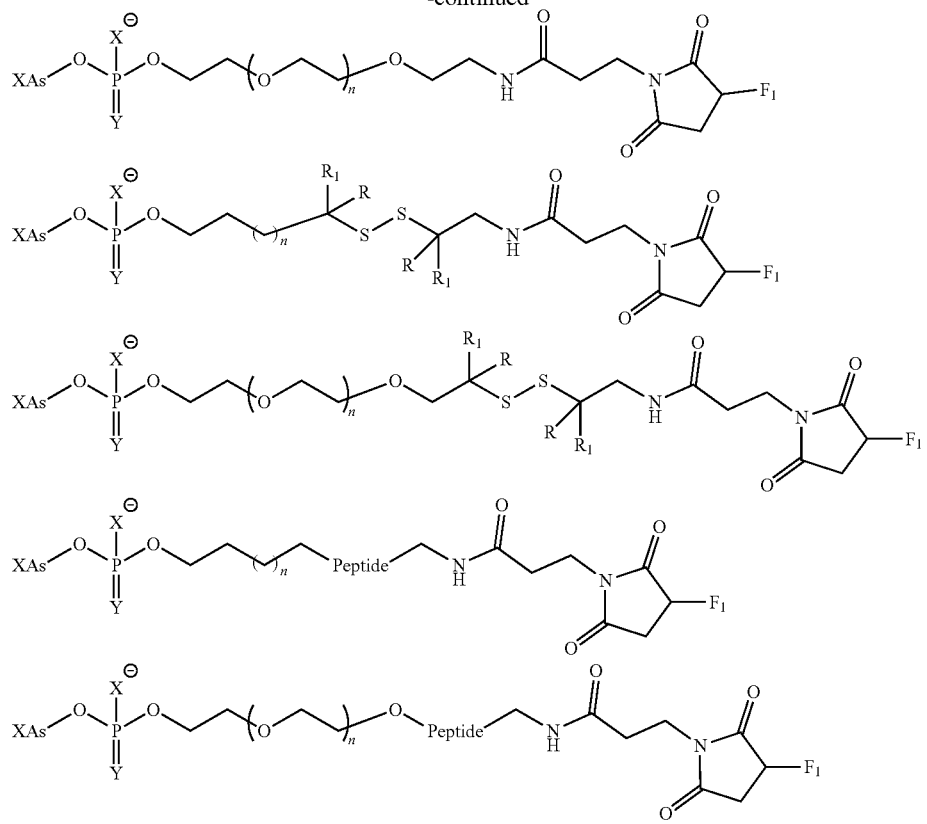

wherein $X_{AS}$ and $F_1$ are as defined above.

In some embodiments, n=0-20. In some embodiments, R and R1 are independently methyl. In some embodiments, R and R1 are independently present or both are absent. In some embodiments, X and Y are independently S. In some embodiments, X and Y are independently present or absent.

In some embodiments, Peptide is an enzymatically cleavable peptide, such as, but not limited to, Val-Cit, Val-Ala etc.

In some embodiments, the linker is covalently attached to F1 through a cysteine residue present on F1, which can be illustrated as follows:

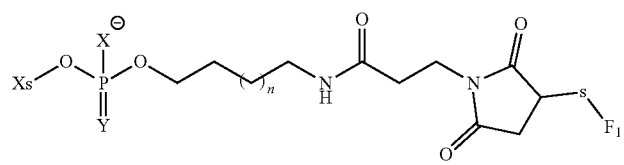

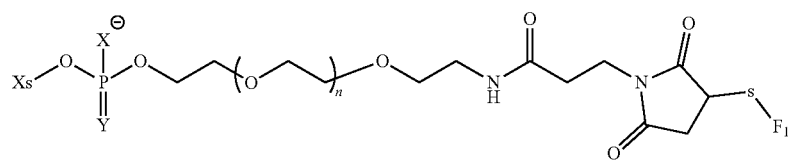

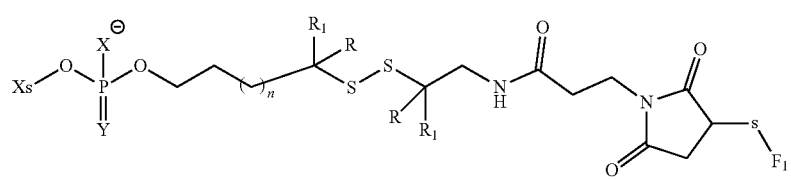

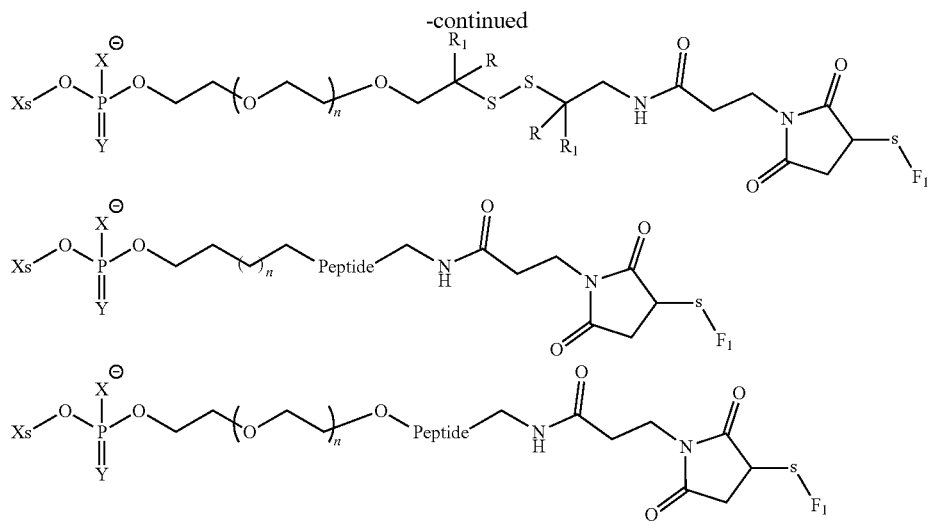

In some embodiments, A1-B1 has a formula of:

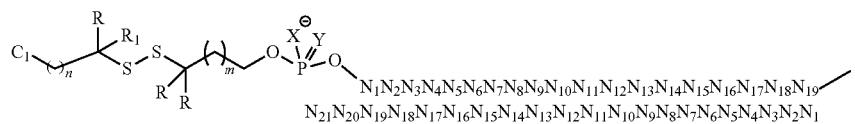

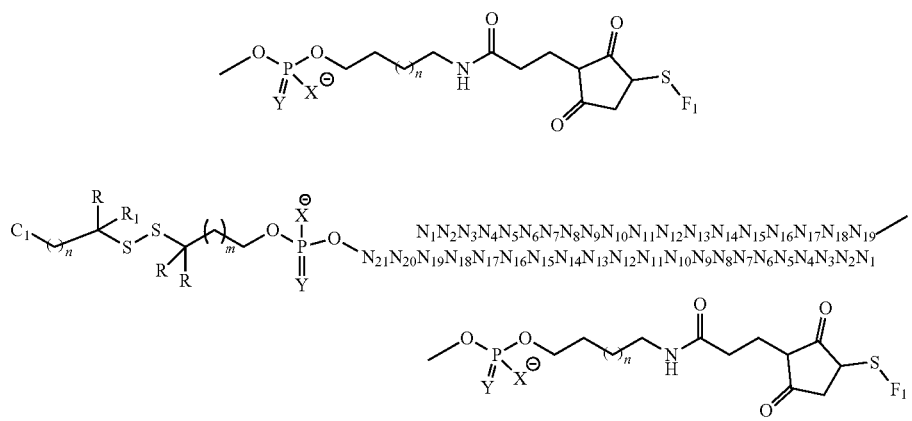

wherein C is the polymer, such as PEG, Endoporter, INF-7, TAT, polyarginine, polylysine, an amphipathic peptide, or peptides listed in Table 9 as provided for herein; $X_S$ is a 5' to 3' oligonucleotide sense strand of a double stranded siRNA molecule; $X_{AS}$ is a 3' to 5' oligonucleotide antisense strand of a double stranded siRNA molecule; and $F_1$ is a polypeptide comprising at least one FN3 domain, wherein $X_S$ and $X_{AS}$ form a double stranded siRNA molecule. The sense and antisense strands are represented by the "N" notations, wherein each nucleotide represented by N, is independently, A, U, C, or G or a modified nucelobase, such as those provided for herein. The $N_1$ nucleotides of the sense strand and the antisense strand represent the 5' end of the respective strands. For clarity, although Formula I utilizes $N_1$, $N_2$, $N_3$, etc. in both the sense and the antisense strand, the nucleotide bases do not need to be the same and are not intended to be the same. The siRNA that is illustrated in Formula I would be complementary to a target sequence.

For example, in some embodiments, the sense strand comprises a 2'O-methyl modified nucleotide with a phosphorothioate (PS) modified backbone at $N_1$ and $N_2$, a 2'-fluoro modified nucleotide at $N_3$, $N_7$, $N_8$, $N_9$, $N_{12}$, and $N_{17}$, and a 2'O-methyl modified nucleotide at $N_4$, $N_5$, $N_6$, $N_{10}$, $N_{11}$, $N_{13}$, $N_{14}$, $N_{15}$, $N_{16}$, $N_{18}$, and $N_{19}$.

In some embodiments, the antisense strand comprises a vinylphosphonate moiety attached to $N_1$, a 2'fluoro-modified nucleotide with a phosphorothioate (PS) modified backbone at $N_2$, a 2'O-methyl modified nucleotide at $N_3$, $N_4$, $N_5$, $N_6$, $N_7$, $N_8$, $N_9$, $N_{10}$, $N_{11}$, $N_{12}$, $N_{13}$, $N_{15}$, $N_{16}$, $N_{17}$, $N_{18}$, and $N_{19}$, a 2'fluoro-modified nucleotide at $N_{14}$, and a 2'O-methyl modified nucleotide with a phosphorothioate (PS) modified backbone at $N_{20}$ and $N_{21}$.

In some embodiments, a compound having a formula of:

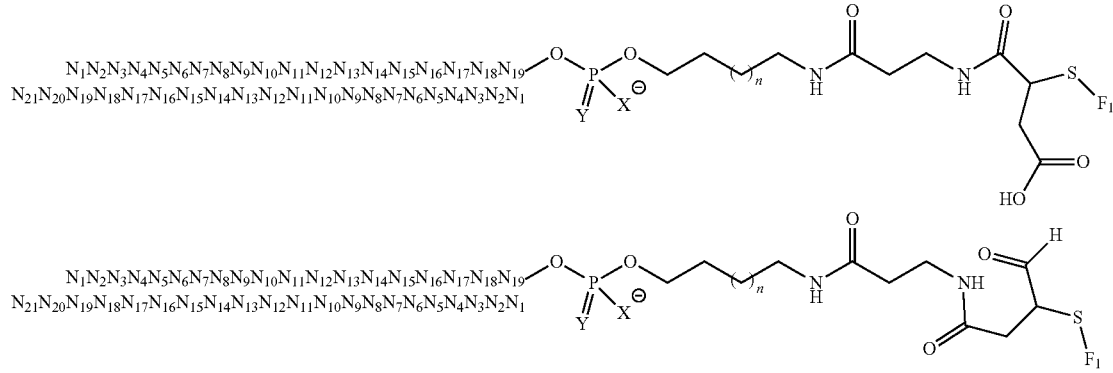

wherein $F_1$ is a polypeptide comprising at least one FN3 domain and is conjugated to a linker, $L_1$, $L_1$ is linked to $X_S$, wherein $X_S$ is a 5' to 3' oligonucleotide sense strand of a double stranded siRNA molecule and $X_{AS}$ is a 3' to 5' oligonucleotide antisense strand of a double stranded siRNA molecule; and wherein $X_S$ and $X_{AS}$ form a double stranded siRNA molecule. The linker illustrated above, is a non-limiting example, and other types of linkers can be used.

In some embodiments, $F_1$ comprises polypeptide having a formula of $(X_1)_n$-$(X_2)_q$-$(X_3)_y$, wherein $X_1$ is a first FN3 domain; $X_2$ is second FN3 domain; $X_3$ is a third FN3 domain or half-life extender molecule; wherein n, q, and y are each independently 0 or 1, provided that at least one of n, q, and y is 1. In some embodiments, n, q, and y are each 1. In some embodiments, n and q are 1 and y is 0. In some embodiments n and y are 1 and q is 0.

In some embodiment $X_1$ is a CD71 FN3 binding domain, such as one provided herein. In some embodiments, $X_2$ is a CD71 FN3 binding domain. In some embodiments, X1 and $X_2$ are different CD71 FN3 binding domains. In some embodiments, the binding domains are the same. In some embodiments, $X_3$ is a FN3 domain that binds to human serum albumin. In some embodiments, $X_3$ is a Fc domain without effector function that extends the half-life of a protein. In some embodiments, $X_1$ is a first CD71 binding domain, $X_2$ is a second CD71 binding domain, and $X_3$ is a FN3 albumin binding domain. Examples of such polypeptides are provided herein and below. In some embodiments, compositions are provided herein having a formula of C—$(X_1)_n$-$(X_2)_q$-$(X_3)_y$-L-$X_4$, wherein C is a polymer, such as PEG, Endoporter, INF-7, TAT, polyarginine, polylysine, an amphipathic peptide, or peptides provided in Table 9; $X_1$ is a first FN3 domain; $X_2$ is second FN3 domain; $X_3$ is a third FN3 domain or half-life extender molecule; L is a linker; and $X_4$ is a nucleic acid molecule, wherein n, q, and y are each independently 0 or 1.

In some embodiments, compositions are provided herein having a formula of $(X1)_n$-$(X2)_q$-$(X3)_y$-L-X4-C, wherein X1 is a first FN3 domain; X2 is second FN3 domain; X3 is a third FN3 domain or half-life extender molecule; L is a linker; X4 is a nucleic acid molecule; and C is a polymer, wherein n, q, and y are each independently 0 or 1.

In some embodiments, compositions are provided herein having a formula of X4-L-$(X1)_n$-$(X2)_q$-$(X3)_y$, wherein X1 is a first FN3 domain; X2 is second FN3 domain; X3 is a third FN3 domain or half-life extender molecule; L is a linker; and X4 is a nucleic acid molecule, wherein n, q, and y are each independently 0 or 1.

In some embodiments, compositions are provided herein having a formula of C-X4-L-$(X1)_n$-$(X2)_q$-$(X3)_y$, wherein C is a polymer; X1 is a first FN3 domain; X2 is second FN3 domain; X3 is a third FN3 domain or half-life extender molecule; L is a linker; and X4 is a nucleic acid molecule, wherein n, q, and y are each independently 0 or 1.

In some embodiments, compositions are provided herein having a formula of X4-L-$(X1)_n$-$(X2)_q$-$(X3)_y$-C, wherein X1 is a first FN3 domain; X2 is second FN3 domain; X3 is a third FN3 domain or half-life extender molecule; L is a linker; X4 is a nucleic acid molecule; and C is a polymer, wherein n, q, and y are each independently 0 or 1.

In some embodiments, the GYS1 siRNA pair may follow the sequence: sense strand (5'-3') nsnsnnnnNfNfNfnnnnnnnnnsnsa and antisense strand (5'-3') UfsNfsnnnNfnnnnnnnNfnNfnnnsusu, wherein (n) is 2'-O-Me (methyl), (Nf) is 2'-F (fluoro), (s) is phosphorothioate backbone modification. Each nucleotide in both sense and antisense strands are modified independently or in combination at ribosugar and nucleobase positions.

In some embodiments, the siRNA molecule comprises a sequence pair from Tables 1A or 1B.

TABLE 1A

| | | siRNA Sense and Anti-sense sequences | | |
|---|---|---|---|---|
| siRNA Pair | SEQ ID NO: | Sense Strand 5'-3' | SEQ ID NO: | Antisense Strand 5'-3' |
| A | 10 | [fC][*mU][*fG][mG][fG][mA][fG] [fG][fA][mU][fG][mA][mA][mU] [fU][mC][fG][mA][mA][T] | 11 | [mU][*fU][*mC][fG][mA][fA][fU][fU] [mC][fA][mU][mC][mC][fU][mC] [fC][mC][fA][mG][*fU][*mU] |
| B | 12 | [fC][*mA][*fA][mG][fG][mU][fG] [fG][fG][mU][fG][mG][mC][mA] [fU][mC][fU][mA][mA][T] | 13 | [mU][*fU][*mA][fG][mA][fU][fG][fC] [mC][fA][mC][mC][mC][fA][mC] [fC][mU][fU][mG][*fU][*mU] |

TABLE 1A-continued siRNA Sense and Anti-sense sequences

| siRNA Pair | SEQ ID NO: | Sense Strand 5'-3' | SEQ ID NO: | Antisense Strand 5'-3' |
|---|---|---|---|---|
| C | 14 | [fU][*mC][*fC][mG][fC][mA][fG][fC][fC][mU][fG][mG][mA][mU][fG][mA][fU][mU][mA][T] | 15 | [mU][*fA][*mA][fU][mC][fA][fU][fC][mC][fA][mG][mG][mC][fU][mG][fC][mG][fG][mA][*fU][*mU] |
| D | 16 | [mG][*mC][*fG][mA][mC][mU][fG][fC][fC][mU][mG][fU][mA][mG][mC][mA][fA][mC][mA][idT] | 17 | [fU][*fG][*mU][mU][mG][mC][mU][mA][mC][mA][mG][mG][mC][fA][mG][mU][mC][mG][mC][*mU] |
| E | 18 | [mU][*mU][*fU][mA][mU][mG][fG][fG][fC][mA][fU][mU][mG][mG][mA][fC][mU][mA][idT] | 19 | [fU][*fA][*mG][mU][mC][mC][mA][mG][mA][mU][mG][mC][mC][fC][mA][mU][mA][mA][*mU] |
| F | 20 | [mG][*mC][*fG][mC][mG][mG][fA][fC][fC][mA][mA][fC][mA][mA][mU][mU][fU][mC][mA][idT] | 21 | [fU][*fG][*mA][mA][mA][mU][mU][mG][mU][mU][mG][mG][mU][fC][mC][mG][mC][mG][mC][*mU] |
| G | 22 | [mG][*mG][*fA][mC][mC][mA][fA][fC][fA][mA][mU][fU][mU][mC][mA][mA][fC][mG][mA][idT] | 23 | [fU][*fC][*mG][mU][mU][mG][mA][mA][mA][mU][mU][mG][mU][fU][mG][mG][mU][mC][mC][*mU] |
| H | 24 | [mA][*mC][*fC][mA][mA][mC][fA][fA][fU][mU][mU][fC][mA][mA][mC][mG][fU][mG][mA][idT] | 25 | [fU][*fC][*mA][mC][mG][mU][mU][mG][mA][mA][mA][mU][mU][fG][mU][mU][mG][mG][mU][*mU] |
| I | 26 | [mG][*mC][*fG][mC][mA][mA][fA][fC][fA][mG][mC][fU][mU][mU][mG][mG][fG][mA][mA][idT] | 27 | [fU][*fU][*mC][mC][mC][mA][mA][mA][mG][mC][mU][mG][mU][fU][mU][mG][mC][mG][mC][*mU] |
| J | 28 | [mA][*mG][*fA][mG][mC][mC][fA][fU][fC][mU][mU][fU][mG][mC][mA][mA][fC][mG][mA][idT] | 29 | [fU][*fC][*mG][mU][mU][mG][mC][mA][mA][mA][mG][mA][mU][fG][mG][mC][mU][mC][mU][*mU] |
| K | 30 | [mG][*mA][*fG][mC][mC][mA][fU][fC][fU][mU][mU][fG][mC][mA][mA][mC][fG][mC][mA][idT] | 31 | [fU][*fG][*mC][mG][mU][mU][mG][mC][mA][mA][mA][mG][mA][fU][mG][mG][mC][mU][mC][*mU] |
| L | 32 | [mA][*mG][*fC][mC][mA][mU][fC][fU][fU][mU][mG][fC][mA][mA][mC][mG][fC][mA][mA][idT] | 33 | [fU][*fU][*mG][mC][mG][mU][mU][mG][mC][mA][mA][mA][mG][fA][mU][mG][mG][mC][mU][*mU] |
| M | 34 | [mC][*mC][*fA][mU][mC][mU][fU][fU][fG][mC][mA][fA][mC][mG][mC][mA][fG][mC][mA][idT] | 35 | [fU][*fG][*mC][mU][mG][mC][mG][mU][mU][mG][mC][mA][mA][fA][mG][mA][mU][mG][mG][*mU] |
| N | 36 | [mA][*mC][*fG][mC][mA][mG][fC][fG][fG][mC][mA][fG][mU][mC][mU][mU][fU][mC][mA][idT] | 37 | [fU][*fG][*mA][mA][mA][mG][mA][mC][mU][mG][mC][mC][mG][fC][mU][mG][mC][mG][mU][*mU] |
| O | 38 | [mU][*mG][*fA][mC][mC][mA][fC][fC][fA][mU][mC][fC][mG][mC][mC][mG][fA][mA][mA][idT] | 39 | [fU][*fU][*mU][mC][mG][mG][mC][mG][mG][mA][mU][mG][mG][fU][mG][mG][mU][mC][mA][*mU] |
| P | 40 | [mC][*mG][*fA][mA][mU][mC][fG][fG][fC][mC][mU][fC][mU][mU][mC][mA][fA][mU][mA][idT] | 41 | [fU][*fA][*mU][mU][mG][mA][mA][mG][mA][mG][mG][mC][mC][fG][mA][mU][mU][mC][mG][*mU] |
| Q | 42 | [mC][*mU][*fU][mC][mA][mA][fU][fA][fG][mC][mA][fG][mU][mG][mC][mC][fG][mA][mA][idT] | 43 | [fU][*fU][*mC][mG][mG][mC][mA][mC][mU][mG][mC][mU][fU][mU][mG][mA][mA][mG][*mU] |

TABLE 1A-continued siRNA Sense and Anti-sense sequences

| siRNA Pair | SEQ ID NO: | Sense Strand 5'-3' | SEQ ID NO: | Antisense Strand 5'-3' |
|---|---|---|---|---|
| R | 44 | [mC][*mA][*fG][mU][mA][mU][fC][fU][fC][mC][mA][fC][mC][mA][mA][mU][fC][mU][mA][idT] | 45 | [fU][*fA][*mG][mA][mU][mU][mG][mG][mU][mG][mG][mA][mG][fA][mU][mA][mC][mU][mG][*mU][*mU] |
| S | 46 | [mC][*mC][*fA][mC][mC][mA][fA][fU][fC][mU][mC][fU][mC][fA][fU][mC][mC][mG][mG][fC][mU][mA][idT] | 47 | [fU][*fA][*mG][mC][mC][mG][mG][mA][mG][mA][mG][mA][mU][fU][mG][mG][mU][mG][mG][*mU][*mU] |
| T | 48 | [mC][*mA][*fC][mC][mA][mA][fU][fC][fU][mC][mU][fC][mC][mG][mG][mC][fU][mU][mA][idT] | 49 | [fU][*fA][*mA][mG][mC][mC][mG][mG][mG][mA][mG][mA][mG][mA][mU][fU][mU][mG][mG][mU][mG][*mU][*mU] |
| U | 50 | [mC][*mC][*fC][mC][mU][mC][fA][fG][fC][mU][mU][fA][mC][mG][mG][mU][fA][mU][mA][idT] | 51 | [fU][*fA][*mU][mA][mC][mC][mG][mU][mA][mA][mG][mC][mU][fG][mA][mG][mG][mG][mG][*mU][*mU] |
| V | 52 | [mC][*mC][*fC][mU][mC][mA][fG][fC][fU][mU][mA][fC][mG][mG][mU][mA][fU][mC][mA][idT] | 53 | [fU][*fG][*mA][mU][mA][mC][mC][mG][mU][mA][mA][mG][mC][fU][mG][mA][mG][mG][mG][*mU][*mU] |
| W | 54 | [mU][*mU][*fA][mC][mG][mG][fU][fA][fU][mC][mU][fA][mC][mA][mU][mU][fC][mU][mA][idT] | 55 | [fU][*fA][*mG][mA][mA][mU][mG][mU][mA][mG][mA][mU][mA][fC][mC][mG][mU][mA][mA][*mU][*mU] |
| X | 56 | [mG][*mG][*fA][mA][mC][mC][fG][fC][fA][mC][mG][fG][mA][mG][mC][mG][fC][mC][mA][idT] | 57 | [fU][*fG][*mG][mC][mG][mC][mU][mC][mC][mG][mU][mG][mC][fG][mG][mU][mU][mC][mC][*mU][*mU] |
| Y | 58 | [mA][*mC][*fG][mG][mA][mG][fC][fG][fC][mC][mU][fC][mU][mC][mC][mG][fA][mC][mA][idT] | 59 | [fU][*fG][*mU][mC][mG][mG][mA][mG][mA][mG][mG][mC][mG][fC][mU][mC][mC][mG][mU][*mU][*mU] |
| Z | 60 | [mA][*mG][*fC][mA][mA][mG][fC][fG][fC][mA][mA][fC][mU][mC][mU][mG][fU][mG][mA][idT] | 61 | [fU][*fC][*mA][mC][mA][mG][mA][mG][mU][mU][mG][mC][mG][fC][mU][mU][mG][mC][mU][*mU][*mU] |
| AA | 62 | [mC][*mA][*fG][mA][mU][mG][fG][fU][fC][mC][mU][fC][mC][mA][mU][mU][fU][mC][mA][idT] | 63 | [fU][*fG][*mA][mA][mA][mU][mG][mG][mA][mG][mG][mA][mC][fC][mA][mU][mC][mU][mG][*mU][*mU] |
| BB | 64 | [mU][*mC][*fU][mA][mG][mA][fU][fC][fU][mG][mG][fA][mA][mC][mC][mU][fU][mA][mA][idT] | 65 | [fU][*fU][*mA][mA][mG][mG][mU][mU][mC][mC][mA][mG][mA][fU][mC][mU][mA][mG][mA][*mU][*mU] |
| CC | 66 | [mC][*mC][*fC][mA][mC][mA][fU][fU][

TABLE 1A-continued siRNA Sense and Anti-sense sequences

| siRNA Pair | SEQ ID NO: | Sense Strand 5'-3' | SEQ ID NO: | Antisense Strand 5'-3' |
|---|---|---|---|---|
| GG | 604 | [fC][*mU][*fG][mG][fG][mA][fG][fG][fA][mU][fG][mA][mA][mU][fG][mA][fG][mG][mA][T] | 605 | [mU][*fU][*mC][fG][mA][fA][fU][fU][mC][fA][mU][mC][mC][fU][mC][fC][mC][fA][mG][*fU][*mU] |
| HH | 606 | [fC][*mU][*fG][mG][fG][mA][fG][fG][fA][mU][fG][mA][mA][mU][fU][mC][fG][mA][mA][T] | 607 | [fU][*fU][*fC][fG][fA][fA][fU][fU][fC][fA][fU][fC][fC][fU][fC][fC][fC][fA][fG][*fU][*fU] |
| II | 608 | [fC][*mU][*fG][mG][fG][mA][fG][fG][fA][mU][fG][mA][mA][mU][fU][mC][fG][mA][mA][T] | 609 | [mU][*fU][*fC][fG][fA][fA][fU][fU][mC][fA][mU][fC][fC][fU][fC][fC][fC][fA][fG][*fU][*mU] |
| JJ | 610 | [fC][*mU][*fG][mG][fG][mA][fG][fG][fA][mU][fG][mA][mA][*fU][idT] | 611 | [mU][*fU][*mC][fG][mA][fA][fU][fU][mC][fA][mU][mC][mC][fU][mC][fC][mC][fA][*mG][*fU][*mU] |
| KK | 612 | [fC][*mA][*fA][mG][fG][mU][fG][fG][mU][fG][mG][mC][mA][fU][fU][fU][mA][mA][idT] | 613 | [mU][*fU][*mA][fG][mA][fU][fG][fC][mC][fA][mC][mC][mC][fA][mC][fC][mU][fU][mG][*fU][*mU] |
| LL | 614 | [fC][*mA][*fA][mG][fG][mU][fG][fG][fG][mU][fG][mG][mC][mA][fU][mC][fU][mA][mG][idT] | 615 | [mU][*fU][*mA][fG][mA][fU][fG][fC][mC][fA][mC][mC][mC][fA][mC][fC][mU][fU][mG][*fU][*mU] |
| MM | 616 | [fC][*mA][*fA][mG][fG][mU][fG][fG][fG][mU][fG][mG][mC][mA][fU][mC][fU][mG][mA][idT] | 617 | [mU][*fU][*mA][fG][mA][fU][fG][fC][mC][fA][mC][mC][mC][fA][mC][fC][mU][fU][mG][*fU][*mU] |
| NN | 618 | [fC][*mA][*fA][mG][fG][mU][fG][fG][fG][mU][fG][mG][mC][mA][fU][mC][fG][mA][mA][idT] | 619 | [mU][*fU][*mA][fG][mA][fU][fG][fC][mC][fA][mC][mC][mC][fA][mC][fC][mU][fU][mG][*fU][*mU] |
| OO | 620 | [fC][*mA][*fA][mG][fG][mU][fG][fG][fG][mU][fG][mG][mC][mA][fU][mA][fU][mA][mA][idT] | 621 | [mU][*fU][*mA][fG][mA][fU][fG][fC][mC][fA][mC][mC][mC][fA][mC][fC][mU][fU][mG][*fU][*mU] |
| PP | 622 | [fC][*mA][*fA][mG][fG][mU][fG][fG][fG][mU][fG][mG][mC][mA][fG][mC][fU][mA][mA][idT] | 623 | [mU][*fU][*mA][fG][mA][fU][fG][fC][mC][fA][mC][mC][mC][fA][mC][fC][mU][fU][mG][*fU][*mU] |
| QQ | 624 | [fC][*mA][*fA][mG][fG][mU][fG][fG][fG][mU][fG][mG][mC][mA][fG][mC][fU][mA][mG][idT] | 625 | [mU][*fU][*mA][fG][mA][fU][fG][fC][mC][fA][mC][mC][mC][fA][mC][fC][mU][fU][mG][*fU][*mU] |
| RR | 626 | [mG][*mA][*fG][mC][mC][mA][fU][fC][fU][mU][mU][fG][mC][mA][mA][mC][fG][mC][mA][idT] | 627 | [mU][*fG][*mC][mG][mU][mU][mG][mC][mA][mA][mA][mG][mA][fU][mG][mG][mC][mU][mC][*mU][*mU] |
| SS | 628 | [mG][*mA][*fG][mC][mC][mA][fU][fC][fU][mU][mU][fG][mC][mA][mA][mC][fG][mC][mG][idT] | 629 | [mU][*fG][*mC][mG][mU][mU][mG][mC][mA][mA][mA][mG][mA][fU][mG][mG][mC][mU][mC][*mU][*mU] |
| TT | 630 | [mG][*mA][*fG][mC][mC][mA][fU][fC][fU][mU][mU][fG][mC][mA][mA][mC][fG][mA][mA][idT] | 631 | [mU][*fG][*mC][mG][mU][mU][mG][mC][mA][mA][mA][mG][mA][fU][mG][mG][mC][mU][mC][*mU][*mU] |
| UU | 632 | [mG][*mA][*fG][mC][mC][mA][fU][fC][fU][mU][mU][fG][mC][mA][mA][mC][fA][mC][mA][idT] | 633 | [mU][*fG][*mC][mG][mU][mU][mG][mC][mA][mA][mA][mG][mA][fU][mG][mG][mC][mU][mC][*mU][*mU] |
| VV | 634 | [mG][*mA][*fG][mC][mC][mA][fU][fC][fU][mU][mU][fG][mC][mA][mA][mA][fG][mC][mA][idT] | 635 | [mU][*fG][*mC][mG][mU][mU][mG][mC][mA][mA][mA][mG][mA][fU][mG][mG][mC][mU][mC][*mU][*mU] |
| WW | 636 | [mG][*mA][*fG][mC][mC][mA][fU][fC][fU][mU][mU][fG][mC][mA][mG][mC][fG][mC][mA][idT] | 637 | [mU][*fG][*mC][mG][mU][mU][mG][mC][mA][mA][mA][mG][mA][fU][mG][mG][mC][mU][mC][*mU][*mU] |

TABLE 1A-continued siRNA Sense and Anti-sense sequences

| siRNA Pair | SEQ ID NO: | Sense Strand 5'-3' | SEQ ID NO: | Antisense Strand 5'-3' |
|---|---|---|---|---|
| XX | 638 | [mG][*mA][*fG][mC][mC][mA][fU][fC][fU][mU][mU][fG][mC][mA][mG][mC][fG][mC][mG][idT] | 639 | [mU][*fG][*mC][mG][mU][mU][mG][mC][mA][mA][mA][mG][mA][fU][mG][mG][mC][mU][mC][*mU][*mU] |
| YY | 640 | [mU][*mU][*fA][mC][mG][fU][fA][fU][mC][mU][fA][mC][mA][mU][mU][fC][mU][mA][idT] | 641 | [mU][*fA][*mG][mA][mA][mU][mG][mU][mA][mG][mA][mU][mA][fC][mC][mG][mU][mA][mA][*mU] |
| ZZ | 642 | [mU][*mU][*fA][mC][mG][fU][fA][fU][mC][mU][fA][mC][mA][mU][mU][fC][mU][mG][idT] | 643 | [mU][*fA][*mG][mA][mA][mG][mU][mA][mG][mA][mU][mA][fC][mC][mG][mU][mA][mA][*mU] |
| AAA | 644 | [mU][*mU][*fA][mC][mG][mG][fU][fA][fU][mC][mU][fA][mC][mA][mU][mU][fC][mG][mA][idT] | 645 | [mU][*fA][*mG][mA][mA][mU][mG][mU][mA][mG][mA][mU][mA][fC][mC][mG][mU][mA][mA][*mU] |
| BBB | 646 | [mU][*mU][*fA][mC][mG][mG][fU][fA][fU][mC][mU][fA][mC][mA][mU][mU][fG][mU][mA][idT] | 647 | [mU][*fA][*mG][mA][mA][mU][mG][mU][mA][mG][mA][mU][mA][fC][mC][mG][mU][mA][mA][*mU] |
| CCC | 648 | [mU][*mU][*fA][mC][mG][mG][fU][fA][fU][mC][mU][fA][mC][mA][mU][mG][fC][mU][mA][idT] | 649 | [mU][*fA][*mG][mA][mA][mU][mG][mU][mA][mG][mA][mU][mA][fC][mC][mG][mU][mA][mA][*mU] |
| DDD | 650 | [mU][*mU][*fA][mC][mG][mG][fU][fA][fU][mC][mU][fA][mC][mA][mU][mG][fC][mU][mA][idT] | 651 | [mU][*fA][*mG][mA][mA][mU][mG][mU][mA][mG][mA][mU][mA][fC][mC][mG][mU][mA][mA][*mU] |
| EEE | 652 | [mU][*mU][*fA][mC][mG][mG][fU][fA][fU][mC][mU][fA][mC][mA][mG][mU][fC][mU][mA][idT] | 653 | [mU][*fA][*mG][mA][mA][mU][mG][mU][mA][mG][mA][mU][mA][fC][mC][mG][mU][mA][mA][*mU] |
| FFF | 654 | [mU][*mU][*fA][mC][mG][mG][fU][fA][fU][mC][mU][fA][mC][mA][mG][mU][fC][mU][mG][idT] | 655 | [mU][*fA][*mG][mA][mA][mU][mG][mU][mA][mG][mA][mU][mA][fC][mC][mG][mU][mA][mA][*mU] |
| GGG | 656 | [fC][*mA][*fA][mG][fG][mU][fG][fG][fG][mU][fG][mG][mC][mA][fU][mC][fU][mA][mG][idT] | 657 | [mU][*fU][*mA][fG][mA][fU][fG][fC][mC][fA][mC][mC][mC][fC][mU][fU][mG][*fU][*mU] |
| HHH | 704 | [mU][*mU][*fA][mC][mG][mG][fU][fA][fU][mC][mU][fA][mC][mA][mU][mU][fC][mU][mA] | 705 | [mU][*fA][*mG][mA][mA][mU][mG][mU][mA][mG][mA][mU][mA][fC][mC][mG][mU][mA][mA][*mU][*mU] |

Abbreviations Key: (n/N = any nucleotide) mN= 2'-O-methyl residues, fN = 2'-F residues, * = phosphorothioate and (idT) = inverted Dt, (VP) 2'-O methyl vinyl phosphonate uridine. The brackets indicate the individual bases.

TABLE 1B

| SEQ ID NO: | Sense strand (5'-3') | SEQ ID NO: | Antisense strand (5'-3') |
|---|---|---|---|
| 801 | caggggugcg gucuugcaa | 861 | uugcaagacc gcaccccugu u |
| 802 | ggugcggucu ugcaauagg | 862 | ccuauugcaa gaccgcaccu u |
| 803 | gugcggucuu gcaauagga | 863 | uccuauugca agaccgcacu u |
| 804 | agccaugccu uuaaaccgc | 864 | gcgguuuaaa ggcaugcuu u |
| 805 | augccuuuaa accgcacuu | 865 | aagugcgguu uaaaggcauu u |
| 806 | ugggaggaug aauucgacc | 866 | ggucgaauuc auccucccau u |

TABLE 1B-continued

| SEQ ID NO: | Sense strand (5'-3') | SEQ ID NO: | Antisense strand (5'-3') |
|---|---|---|---|
| 807 | aacgcagugc ucuucgaag | 867 | cuucgaagag cacugcguuu u |
| 808 | ggacgaaugg ggcgacaac | 868 | guugucgccc cauucguccu u |
| 809 | ggcgacugcc uguagcaac | 869 | guugcuacag gcagucgccu u |
| 810 | cacgcugcug gggcgcuac | 870 | guagcgcccc agcagcgugu u |
| 811 | ugcgcucacg ucuucacua | 871 | uagugaagac gugagcgcau u |
| 812 | ccuuauacuu cuuuaucgc | 872 | gcgauaaaga aguauaaggu u |
| 813 | cuuuaucgcc ggccgcuau | 873 | auagcggccg gcgauaaagu u |
| 814 | ucgccggccg cuaugaguu | 874 | aacucauagc ggccggcgau u |
| 815 | gccgcuauga guucuccaa | 875 | uuggagaacu cauagcggcu u |
| 816 | ccgcuaugag uucuccaac | 876 | guuggagaac ucauagcggu u |
| 817 | ggcucggcuc aacuaucug | 877 | cagauaguug agccgagccu u |
| 818 | gcucggcuca acuaucugc | 878 | gcagauaguu gagccgagcu u |
| 819 | ucggcucaac uaucugcuc | 879 | gagcagauag uugagccgau u |
| 820 | ccagcgcgga ccaacaauu | 880 | aauuguuggu ccgcgcuggu u |
| 821 | agcgcggacc aacaauuuc | 881 | gaaauuguug guccgcgcuu u |
| 822 | ucgggaggaa gcuuuauga | 882 | ucauaaagcu uccucccgau u |
| 823 | acgcagcggc agucuuucc | 883 | ggaaagacug ccgcugcguu u |
| 824 | gaccaccauc cgccgaauc | 884 | gauucggcgg auggugucu u |
| 825 | ccgaaucggc cucuucaau | 885 | auugaagagg ccgauucggu u |
| 826 | aaucggccuc uucaauagc | 886 | gcuauugaag aggccgauuu u |
| 827 | caauagcagu gccgacagg | 887 | ccugucggca cugcuauugu u |
| 828 | aggaguuugu ccguggcug | 888 | cagccacgga caaacuccuu u |
| 829 | cggcugagug cacgguuau | 889 | auaaccgugc acucagccgu u |
| 830 | ugggaauccc caguaucuc | 890 | gagauacugg gauucccau u |
| 831 | cagacccuc agcuuacgg | 891 | ccguaagcug aggggucugu u |
| 832 | ccccucagcu uacgguauc | 892 | gauaccguaa gcugagggu u |
| 833 | cucagcuuac gguaucuac | 893 | guagauaccg uaagcugagu u |
| 834 | gcuuacguua ucuacauuc | 894 | gaauguagau accguaagcu u |
| 835 | ccggcggcag cguaucauc | 895 | gaugauacgc ugccgccggu u |
| 836 | agcguaucau ccagcggaa | 896 | uuccgcugga ugauacgcuu u |
| 837 | gcguaucauc cagcggaac | 897 | guuccgcugg augauacgcu u |
| 838 | uaccuaggcc gguacuaua | 898 | uauaguaccg gccuagguau u |
| 839 | cuaggccggu acuauaugu | 899 | acauauagua ccggccuagu u |
| 840 | aggccgguac uauaugucu | 900 | agacauauag uaccggccuu u |
| 841 | ggccgguacu auaugucug | 901 | cagacauaua guaccggccu u |
| 842 | gccgguacua uaugucugc | 902 | gcagacauau aguaccggcu u |
| 843 | cgguacuaua ugucugcgc | 903 | gcgcagacau auaguaccgu u |
| 844 | gguacuauau gucugcgcg | 904 | cgcgcagaca uauaguaccu u |
| 845 | cuauaugucu gcgcgccac | 905 | guggcgcgca gacauauagu u |

TABLE 1B-continued

| SEQ ID NO: | Sense strand (5'-3') | SEQ ID NO: | Antisense strand (5'-3') |
|---|---|---|---|
| 846 | uaugucugcg cgccacaug | 906 | cauguggcgc gcagacauau u |
| 847 | augucugcgc gccacaugg | 907 | ccauguggcg cgcagacauu u |
| 848 | ucgcccucgc ugucacgac | 908 | gucgugacag cgagggcgau u |
| 849 | cggcgagcgc uacgaugag | 909 | cucaucguag cgcucgccgu u |
| 850 | caaggaccgg cgcaacauc | 910 | gauguugcgc cggccuugu u |
| 851 | acauccgugc accagagug | 911 | cacucggug cacggauguu u |
| 852 | cugggcgagg agcguaacu | 912 | aguuacgcuc cucgcccagu u |
| 853 | gggcgaggag cguaacuaa | 913 | uuaguuacgc uccucgcccu u |
| 854 | gcgaggagcg uaacuaagu | 914 | acuuaguuac gcuccucgcu u |
| 855 | gaggagcgua acuaagucc | 915 | ggacuuaguu acgcuccucu u |
| 856 | aguccgccaa acacuccac | 916 | guggagugu uggcggacuu u |
| 857 | ggcgaucaag uccagagcc | 917 | ggcucuggac uugaucgccu u |
| 858 | cccuaaccug gcuuauucc | 918 | ggaauaagcc agguuagggu u |
| 859 | ugugaaacca cuagguucu | 919 | agaaccuagu gguuucacau u |
| 860 | accacuaggu ucuaggucc | 920 | ggaccuagaa ccuaguguu u |
| 921 | caggggugcg gucuugcaa | 981 | uugcaagacc gcaccccugu u |
| 922 | ggugcggucu ugcaauaga | 982 | ucuauugcaa gaccgcaccu u |
| 923 | gugcggucuu gcaauagga | 983 | uccauugca agaccgcacu u |
| 924 | agccaugccu uuaaaccga | 984 | ucgguuaaaa ggcauggcuu u |
| 925 | augccuuuaa accgcacua | 985 | uagugcgguu uaaaggcauu u |
| 926 | ugggaggaug aauucgaca | 986 | ugucgaauuc auccucccau u |
| 927 | aacgcagugc ucuucgaaa | 987 | uuucgaagag cacugcguuu u |
| 928 | ggacgaaugg ggcgacaaa | 988 | uuugucgccc cauucguccu u |
| 929 | ggcgacugcc uguagcaaa | 989 | uuugcuacag gcagucgccu u |
| 930 | cacgcugcug gggcgcuaa | 990 | uuagcgcccc agcagcgugu u |
| 931 | ugcgcucacg ucuucacua | 991 | uagugaagac gugagcgcau u |
| 932 | ccuuauacuu cuuuaucga | 992 | ucgauaaaga aguauaaggu u |
| 933 | cuuuaucgcc ggccgcuaa | 993 | uuagcggccg gcgauaaagu u |
| 934 | ucgccggccg cuaugagua | 994 | uacucauagc ggccggcgau u |
| 935 | gccgcuauga guucuccaa | 995 | uuggagaacu cauagcggcu u |
| 936 | ccgcuaugag uucuccaaa | 996 | uuuggagaac ucauagcggu u |
| 937 | ggcucggcuc aacuaucua | 997 | uagauaguug agccgagccu u |
| 938 | gcucggcuca acuaucuga | 998 | ucagauaguu gagccgagcu u |
| 939 | ucggcucaac uaucugcua | 999 | uagcagauag uugagccgau u |
| 940 | ccagcgcgga ccaacaaua | 1000 | uauuguuggu ccgcgcuggu u |
| 941 | agcgcggacc aacaauuua | 1001 | uaaauuguug guccgcgcuu u |
| 942 | ucgggaggaa gcuuuauga | 1002 | ucauaaagcu uccucccgau u |
| 943 | acgcagcggc agucuuuca | 1003 | ugaaagacug ccgcugcguu u |
| 944 | gaccaccauc cgccgaaua | 1004 | uauucggcgg augguggucu u |

TABLE 1B-continued

| SEQ ID NO: | Sense strand (5'-3') | SEQ ID NO: | Antisense strand (5'-3') |
|---|---|---|---|
| 945 | ccgaaucggc cucuucaaa | 1005 | uuugaagagg ccgauucggu u |
| 946 | aaucggccuc uucaauaga | 1006 | ucuauugaag aggccgauuu u |
| 947 | caauagcagu gccgacaga | 1007 | ucugucggca cugcuaugu u |
| 948 | aggaguuugu ccguggcua | 1008 | uagccacgga caaacuccuu u |
| 949 | cggcugagug cacgguuaa | 1009 | uuaaccgugc acucagccgu u |
| 950 | ugggaauccc caguaucua | 1010 | uagauacugg ggauucccau u |
| 951 | cagaccccuc agcuuacga | 1011 | ucguaagcug aggggucugu u |
| 952 | ccccucagcu uacgguaua | 1012 | uauaccguaa gcugaggggu u |
| 953 | cucagcuuac gguaucuaa | 1013 | uuagauaccg uaagcugagu u |
| 954 | gcuuacggua ucuacauua | 1014 | uaauguagau accguaagcu u |
| 955 | ccggcggcag cguaucaua | 1015 | uaugauacgc ugccgccggu u |
| 956 | agcguaucau ccagcggaa | 1016 | uuccgcugga ugauacgcuu u |
| 957 | gcguaucauc cagcggaaa | 1017 | uuuccgcugg augauacgcu u |
| 958 | uaccuaggcc gguacuaua | 1018 | uauaguaccg gccagguau u |
| 959 | cuaggccggu acuauauga | 1019 | ucauauagua ccggccuagu u |
| 960 | aggccgguac uauaugca | 1020 | ugacauauag uaccggccuu u |
| 961 | ggccgguacu auaugucua | 1021 | uagacauaua guaccggccu u |
| 962 | gccgguacua uaugucuga | 1022 | ucagacauau aguaccggcu u |
| 963 | cgguacuaua ugucugcga | 1023 | ucgcagacau auaguaccgu u |
| 964 | gguacuauau gucugcgca | 1024 | ugcgcagaca uauaguaccu u |
| 965 | cuauaugucu gcgcgccaa | 1025 | uuggcgcgca gacauauagu u |
| 966 | uaugucugcg cgccacaua | 1026 | uauguggcgc gcagacauau u |
| 967 | augucugcgc gccacauga | 1027 | ucauguggcg cgcagacauu u |
| 968 | ucgcccucgc ugucacgaa | 1028 | uucgugacag cgagggcgau u |
| 969 | cggcgagcgc uacgaugaa | 1029 | uucaucguag cgcucgccgu u |
| 970 | caaggaccgg cgcaacaua | 1030 | uauguugcgc cggccuugu u |
| 971 | acauccgugc accagagua | 1031 | uacucuggug cacggaugu u |
| 972 | cugggcgagg agcguaaca | 1032 | uguuacgcuc cucgcccagu u |
| 973 | gggcgaggag cguaacuaa | 1033 | uuaguuacgc uccucgcccu u |
| 974 | gcgaggagcg uaacuaaga | 1034 | ucuuaguuac gcuccucgcu u |
| 975 | gaggagcgua acuaaguca | 1035 | ugacuuaguu acgcuccucu u |
| 976 | aguccgccaa acacuccaa | 1036 | uuggagugu ggcggacuu u |
| 977 | ggcgaucaag uccagagca | 1037 | ugcucuggac uugaucgccu u |
| 978 | cccuaaccug gcuuauuca | 1038 | ugaauaagcc agguuagggu u |
| 979 | ugugaaacca cuagguuca | 1039 | ugaaccuagu gguuucacau u |
| 980 | accacuaggu ucuagguca | 1040 | ugaccuagaa ccuaggguu u |
| 1041 | uggacuucaaccuagacaa | 1042 | uugucuagguugaaguccauu |
| 1043 | cugggaggaugaauucgaa | 1044 | uucgaauucauccucccagu |
| 1045 | gggugacaacuacuaucua | 1046 | uagauaguaguugucacccuu |

TABLE 1B-continued

| SEQ ID NO: | Sense strand (5'-3') | SEQ ID NO: | Antisense strand (5'-3') |
|---|---|---|---|
| 1047 | cugggaggaugaauucgaa | 1048 | uucgaauucauccucccaguu |
| 1049 | caaggugggugg caucuaa | 1050 | uuagaugccacccaccuuguu |
| 1051 | uccgcagccuggaugauua | 1052 | uaaucauccaggcugcggauu |

In some embodiments, the polynucleotides illustrated above include those that do not include a 2'-O methyl vinyl phosphonate uridine as the 5' nucleotide on the antisense strand of the siRNA.

In some embodiments, a polynucleotide is as provided for herein. In some embodiments, the polynucleotide comprises a first strand and a second strand to for a portion that comprises a duplex. In some embodiments, the polynucleotide comprises a sense strand and an antisense strand. In some embodiments, comprises the sequences as illustrated in Tables 1A or 1B. In some embodiments, comprises the sequences as illustrated in Tables 1A or 1B but without the base modifications. In some embodiments, a pharmaceutical composition comprises a siRNA pair as provided herein. In some embodiments, the siRNA pair is not conjugated to a FN3 domain.

In some embodiments, an oligonucleotide molecule described herein is constructed using chemical synthesis and/or enzymatic ligation reactions using procedures known in the art. For example, an oligonucleotide molecule is chemically synthesized using naturally occurring nucleotides or variously modified nucleotides designed to increase the biological stability of the molecules or to increase the physical stability of the duplex formed between the oligonucleotide molecule and target nucleic acids. Alternatively, the oligonucleotide molecule is produced biologically using an expression vector into which a oligonucleotide molecule has been subcloned in an antisense orientation (i.e., RNA transcribed from the inserted oligonucleotide molecule will be of an antisense orientation to a target polynucleic acid molecule of interest).

In some embodiments, an oligonucleotide molecule is synthesized via a tandem synthesis methodology, wherein both strands are synthesized as a single contiguous oligonucleotide fragment or strand separated by a cleavable linker which is subsequently cleaved to provide separate fragments or strands that hybridize and permit purification of the duplex.

In some instances, an oligonucleotide molecule is also assembled from two distinct nucleic acid strands or fragments wherein one fragment includes the sense region and the second fragment includes the antisense region of the molecule.

In some instances, while chemical modification of the oligonucleotide molecule internucleotide linkages with phosphorothioate, phosphorodithioate, phosphonate, phosphoramidate, or mesyl phosphoramidate, linkages improves stability. Excessive modifications sometimes cause toxicity or decreased activity. Therefore, when designing nucleic acid molecules, the amount of these internucleotide linkages in some cases is minimized. In such cases, the reduction in the concentration of these linkages lowers toxicity, increases efficacy and higher specificity of these molecules.

As described herein, in some embodiments, the nucleic acid molecules can be modified to include a linker at the 5' end of the of the sense strand of the dsRNA. In some embodiments, the nucleic acid molecules can be modified to include a vinyl phosphonate or modified vinyl phosphonate at the 5' end of the of the anti-sense strand of the dsRNA. In some embodiments, the nucleic acid molecules can be modified to include a linker at the 3' end of the of the sense strand of the dsRNA. In some embodiments, the nucleic acid molecules can be modified to include a vinyl phosphonate at the 3' end of the of the anti-sense strand of the dsRNA. The linker can be used to link the dsRNA to the FN3 domain. The linker can covalently attach, for example, to a cysteine residue on the FN3 domain that is there naturally or that has been substituted as described herein, and for example, in U.S. Pat. No. 10,196,446, which is hereby incorporated by reference in its entirety. Non-limiting examples of such modified strands of the dsRNA are illustrated in Table 2.

TABLE 2

Pairs with Linker and/or vinyl phosphonate

| siRNA Pair | SEQ ID NO: | Sense Strand 5'-3' | SEQ ID NO: | Antisense Strand 5'-3' | L = linker |
|---|---|---|---|---|---|
| III | 70 | [mU][*mC][*fU][mC][fG][mU][fG][mG][fC][mC][fU][mU][fA][mA][fU][mG][fA][mA]-L | 71 | [VP][*fU][*mU][fC][mA][fU][mU][fA][mA][fG][mG][fC][mC][fA][mC][fG][mA][fG][mA][*mU][*mU] | Mal-$C_2H_4C$(O)(NH)-$(CH_2)_6$- |
| JJJ | 72 | [fC][*mU][*fG][mG][fG][mA][fG][fG][fA][mU][fG][mA][mA][mU][fU][mC][fG][mA][mA]-L | 73 | [VP][*fU][*mC][mG][mA][mA][mU][mU][mC][mA][mU][mC][mC][fU][mC][mC][mC][mA][mG][*mU][*mU] | Mal-$C_2H_4C$(O)(NH)-$(CH_2)_6$- |
| KKK | 74 | [fC][*mA][*fA][mG][fG][mU][fG][fG][fG][mU][fG][mG][mC][mA][fU][mC][fU][mA][mA]-L | 75 | [VP][*fU][*mA][fG][mA][fU][fG][fC][mC][fA][mC][mC][mC][fC][mU][fU][mG][*fU][*mU] | Mal-$C_2H_4C$(O)(NH)-$(CH_2)_6$- |

TABLE 2-continued

Pairs with Linker and/or vinyl phosphonate

| siRNA Pair | SEQ ID NO: | Sense Strand 5'-3' | SEQ ID NO: | Antisense Strand 5'-3' | L = linker |
|---|---|---|---|---|---|
| LLL | 76 | [mG][*mC][*fG][mC][mG][fA][fC][fC][mA][mA][fC][mA][mA][mU][mU][fU][mC][mA]-L | 77 | [VP][*fG][*mA][mA][mA][mU][mU][mG][mU][mU][mG][mG][mU][fC][mC][mG][mC][mG][mC][*mU][*mU] | Mal-C$_2$H$_4$C(O)(NH)-(CH$_2$)$_6$- |
| MMM | 78 | [mG][*mA][*fG][mC][mC][mA][fU][fC][fU][mU][fG][mC][mA][mA][mC][fG][mC][mA]-L | 79 | [VP][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| NNN | 80 | [mA][*mG][*fC][mC][mA][mU][fC][fU][fU][mU][mG][fC][mA][mA][mC][mG][fC][mA][mA]-L | 81 | [VP][*fU][*mG][mC][mG][mU][mU][mG][mC][mA][mA][mA][mG][fA][mU][mG][mG][mC][mU][*mU][*mU] | Mal-C$_2$H$_4$C(O)(NH)-(CH$_2$)$_6$- |
| OOO | 82 | [mU][*mU][*fA][mC][mG][mG][fU][fA][fU][mC][mU][fA][mC][mA][mU][mU][fC][mU][mA]-L | 83 | [VP][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| OPPP | 84 | [mC][*mC][*fC][mA][mC][mA][fU][fU][fU][mA][mC][fC][mU][mC][mG][mA][fG][mG][mA]-L | 85 | [VP][*fC][*mC][mU][mC][mG][mA][mG][mG][mU][mA][mA][mA][mA][fU][mG][mU][mG][mG][mG][*mU][*mU] | Mal-C$_2$H$_4$C(O)(NH)-(CH$_2$)$_6$- |
| QQQ | 86 | [mU][*mC][*fU][mC][fG][mU][fG][mG][fC][mC][fU][mU][fA][mA][fU][mG][mG][mA]-L | 87 | [VP][*fU][*mU][fC][mA][fU][mU][fA][mA][mG][mG][fC][mC][fA][mC][fG][mA][fG][mA][*mU] | Mal-C$_2$H$_4$C(O)(NH)-(CH$_2$)$_6$- |
| RRR | 658 | [fC][*mA][*fA][mG][fG][mU][fG][fG][fG][mU][fG][mG][mC][mA][fU][mC][fU][mA][mA][idT]-L | 659 | [VP][mU][*fU][*mA][fG][mA][fU][fG][fC][mC][fA][mC][mC][fA][mC][fC][mU][fU][mG][*fU][*mU] | Mal-C$_2$H$_4$C(O)(NH)-(CH$_2$)$_6$- |
| SSS | 660 | [fC][*mA][*fA][mG][fG][mU][fG][fG][fG][mU][fG][mG][mC][mA][fU][mC][fU][mA][mG][idT]-L | 661 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| TTT | 662 | [fC][*mA][*fA][mG][fG][mU][fG][fG][fG][mU][fG][mG][mC][mA][fU][mC][fU][mG][mA][idT]-L | 663 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| UUU | 664 | [fC][*mA][*fA][mG][fG][mU][fG][fG][fG][mU][fG][mG][mC][mA][fU][mC][fG][mA][mA][idT]-L | 665 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| VVV | 666 | [fC][*mA][*fA][mG][fG][mU][fG][fG][fG][mU][fG][mG][mC][mA][fU][mA][fU][mA][mA][idT]-L | 667 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| WWW | 668 | [fC][*mA][*fA][mG][fG][mU][fG][fG][fG][mU][fG][mG][mC][mA][fG][mC][fU][mA][mA][idT]-L | 669 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| XXX | 670 | [fC][*mA][*fA][mG][fG][mU][fG][fG][fG][mU][fG][mG][mC][mA][fG][mC][fU][mA][mG][idT]-L | 671 | [VP][mU][*fU][*mA][fG][mA][fU][fG][fC][mC][fA][mC][mC][fA][fC][fC][mU][fU][mG][*fU][*mU] | Mal-C$_2$H$_4$C(O)(NH)-(CH$_2$)$_6$- |
| YYY | 672 | [mG][*mA][*fG][mC][mC][mA][fU][fC][fU][mU][mU][fG][mC][mA][mA][mC][fG][mC][mA][idT]-L | 673 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |

TABLE 2-continued

Pairs with Linker and/or vinyl phosphonate

| siRNA Pair | SEQ ID NO: | Sense Strand 5'-3' | SEQ ID NO: | Antisense Strand 5'-3' | L = linker |
|---|---|---|---|---|---|
| ZZZ | 674 | [mG][*mA][*fG][mC][mC][mA][fU][fC][fU][mU][mU][fG][mC][mA][mA][mC][fG][mC][mG][idT]-L | 675 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| AAAA | 676 | [mG][*mA][*fG][mC][mC][mA][fU][fC][fU][mU][mU][fG][mC][mA][mA][mC][fG][mA][mA][idT]-L | 677 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| BBBB | 678 | [mG][*mA][*fG][mC][mC][mA][fU][fC][fU][mU][mU][fG][mC][mA][mA][mC][fA][mC][mA][idT]-L | 679 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| CCCC | 680 | [mG][*mA][*fG][mC][mC][mA][fU][fC][fU][mU][mU][fG][mC][mA][mA][mA][fG][mC][mA][idT]-L | 681 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| DDDD | 682 | [mG][*mA][*fG][mC][mC][mA][fU][fC][fU][mU][mU][fG][mC][mA][mG][mC][fG][mC][mA][idT]-L | 683 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| EEEE | 684 | [mG][*mA][*fG][mC][mC][mA][fU][fC][fU][mU][mU][fG][mC][mA][mG][mC][fG][mC][mG][idT]-L | 685 | [VP][mU][*fG][*mC][mG][mU][mU][mG][mC][mA][mA][mA][mG][mA][fU][mG][mG][mC][mU][mC][*mU][*mU] | Mal-C$_2$H$_4$C(O)(NH)-(CH$_2$)$_6$- |
| FFFF | 686 | [mU][*mU][*fA][mC][mG][mG][fU][fA][fU][mC][mU][fA][mC][mA][mU][mU][fC][mU][mA][idT]-L | 687 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| GGGG | 688 | [mU][*mU][*fA][mC][mG][mG][fU][fA][fU][mC][mU][fA][mC][mA][mU][mU][fC][mU][mG][idT]-L | 689 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| HHHH | 690 | [mU][*mU][*fA][mC][mG][mG][fU][fA][fU][mC][mU][fA][mC][mA][mU][mU][fC][mG][mA][idT]-L | 691 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| IIII | 692 | [mU][*mU][*fA][mC][mG][mG][fU][fA][fU][mC][mU][fA][mC][mA][mU][mU][fG][mU][mA][idT]-L | 693 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| JJJJ | 694 | [mU][*mU][*fA][mC][mG][mG][fU][fA][fU][mC][mU][fA][mC][mA][mU][mG][fC][mU][mA][idT]-L | 695 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| KKKK | 696 | [mU][*mU][*fA][mC][mG][mG][fU][fA][fU][mC][mU][fA][mC][mA][mU][mG][fC][mU][mA][idT]-L | 697 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| LLLL | 698 | [mU][*mU][*fA][mC][mG][mG][fU][fA][fU][mC][mU][fA][mC][mA][mG][mU][fC][mU][mA][idT]-L | 699 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| MMMM | 700 | [mU][*mU][*fA][mC][mG][mG][fU][fA][fU][mC][mU][fA][mC][mA][mG][mU][fC][mG][mA][idT]-L | 701 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| NNNN | 702 | [fC][*mA][*fA][mG][fG][mU][fG][fG][fG][mU][fG][mG][mC] | 703 | [VP][mU][*fU][*mA][fG][mA][fU][fG][fC][mC][fA][mC][mC] | Mal-C$_2$H$_4$C |

TABLE 2-continued

Pairs with Linker and/or vinyl phosphonate

| siRNA Pair | SEQ ID NO: | Sense Strand 5'-3' | SEQ ID NO: | Antisense Strand 5'-3' | L = linker |
|---|---|---|---|---|---|
| | | [mA][fU][mC][fU][mA][mG][idT]-L | | [mC][fA][mC][fC][mU][fU][mG][*fU][*mU] | (O)(NH)-(CH$_2$)$_6$- |
| OOOO | 706 | [mU][*mU][*fA][mC][mG][mG][fU][fA][fU][mC][mU][fA][mC][mA][mU][mU][fC][mU][mA]-L | 707 | [VP][mU][*fA][*mG][mA][mA][mU][mG][mU][mA][mG][mA][mU][mA][fC][mC][mG][mU][mA][mA][*mU][*mU] | Mal-C$_2$H$_4$C(O)(NH)-(CH$_2$)$_6$- |
| PPPP | 711 | [mU][*mG][*fG][mA][mC][mU][fU][fC][fA][mA][mC][fC][mU][mA][mG][mA][fC][mA][mA]-L | 712 | [VP][mU][*fU][*mG][mU][mC][mU][mA][mG][mG][mU][mU][mG][mA][fA][mG][mU][mC][mC][mA][*mU][*mU] | Mal-C$_2$H$_4$C(O)(NH)-(CH$_2$)$_6$- |
| QQQQ | 1053 | [mG][*mG][*fG][mU][mG][mA][fC][fA][fA][mC][mU][fA][mC][mU][mA][mU][fC][mU][mA] | 1054 | [VP][mU][fA][*mG][*mA][mU][mA][mG][mU][mA][mG][mU][mU][mG][fU][mC][mA][mC][mC][mC][*mU][*mU] | Mal-C$_2$H$_4$C(O)(NH)-(CH$_2$)$_6$- |
| RRRR | 1055 | [fC][*mU][*fG][mG][fG][mA][fG][mG][fA][mU][fG][mA][fA][mU][fU][mC][fG][mA][fA] | 1056 | [VP][mU][*fU][*mC][fG][mA][fA][mU][fU][mC][fA][mU][fC][mC][fU][mC][fC][mC][fA][mG][*fU][*mU] | Mal-C$_2$H$_4$C(O)(NH)-(CH$_2$)$_6$- |
| SSSS | 1057 | [fC][*mA][[*fA][mG][fG][mU][fG][mG][fG][mU][fG][mG][fC][mA][fU][mC][fU][mA][fA] | 1058 | [VP][mU][*fU][*mA][fG][mA][fU][mG][fC][mC][fA][mC][fC][mC][fA][mC][fC][mU][fU][mG][*fU][*mU] | Mal-C$_2$H$_4$C(O)(NH)-(CH$_2$)$_6$- |
| TTTT | 1059 | [fU][*mC][*fC][mG][fC][mA][fG][mC][fC][mU][fG][mG][fA][mU][fG][mA][fU][mU][fA] | 1060 | [VP]mU][*fA][*mA][fU][mC][fA][mU][fC][mC][fA][mG][fG][mC][fU][mG][fC][mG][fG][mA][(fU][*mU] | Mal-C$_2$H$_4$C(O)(NH)-(CH$_2$)$_6$- |

In some embodiments, the siRNA pairs of A to PPPP provided for above comprise a linker at the 3' end of the sense strand. In some embodiments, the siRNA pairs of A to PPPP provided for above comprise a vinyl phosphonate at the 5' end of the sense strand.

Abbreviations Key: (n/N=any nucleotide) mN=2'-O-methyl residues, fN=2'-F residues, *=phosphorothioate, (idT)=inverted Dt, (VP) 2'-O methyl vinyl phosphonate uridine, BMPS=propyl maleimide, Structure of the linkers (L) are as follows in Table 3.

TABLE 3

Representative examples of Linkers (L)

| Linker Structure | Linker Name |
|---|---|
| (structure shown) | Mal-C$_2$H$_4$C(O)(NH)-(CH$_2$)$_6$ |
| (structure shown) | Mal-(PEG)$_{12}$(NH)(CH$_2$)$_6$ |
| (structure shown) | Mal-NH-(CH$_2$)$_6$ or Aminohexyl linker-(CH$_2$)$_6$— |

TABLE 3-continued

Representative examples of Linkers (L)

| Linker Structure | Linker Name |
| --- | --- |
| | Val-Cit-PABA |

Other linkers can also be used, such as, linkers formed with click chemistry, amide coupling, reductive amination, oxime, enzymatic couplings such as transglutaminase and sortage conjugations. The linkers provided here are exemplary in nature and other linkers made with other such methods can also be used.

When connected to the siRNA, the structures, L-(X4) can be represented by the following formulas:

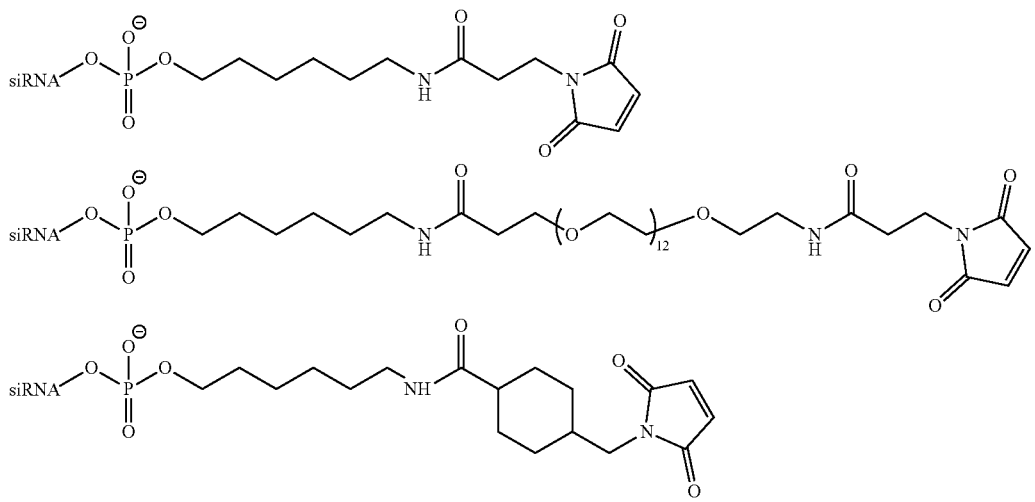

Although certain siRNA sequences are illustrated herein with certain modified nucleobases, the sequences without such modifications are also provided herein. That is, the sequence can comprise the sequences illustrated in the tables provided herein without any modifications. The unmodified siRNA sequences can still comprise, in some embodiments, a linker at the 5' end of the of the sense strand of the dsRNA. In some embodiments, the nucleic acid molecules can be modified to include a vinyl phosphonate at the 5' end of the of the anti-sense strand of the dsRNA. In some embodiments, the nucleic acid molecules can be modified to include a linker at the 3' end of the of the sense strand of the dsRNA. In some embodiments, the nucleic acid molecules can be modified to include a vinyl phosphonate at the 3' end of the of the anti-sense strand of the dsRNA. The linker can be as provided herein.

In some embodiments, the FN3 proteins comprise a polypeptide comprising a polypeptide that binds CD71 are provided. In some embodiments, the polypeptide comprises a FN3 domain that binds to CD71. In some embodiments, the polypeptide comprises a sequence of SEQ ID NOs: 273, 288-291, 301-310, 312-572, 592-599, or 708-710 are provided. In some embodiments, the polypeptide that binds CD71 comprises a sequence of SEQ ID NOs: 301-301, 310, 312-572, 592-599, or 708-710. The sequence of CD71 protein that the polypeptides can bind to can be, for example, SEQ ID Nos: 2 or 3. In some embodiments, the FN3 domain that binds to CD71 specifically binds to CD71.

In some embodiments, the FN3 domain that binds CD71 is based on Tencon sequence of SEQ ID NO:1 or Tencon 27 sequence of SEQ ID NO:4 (LPAPKNLVVSRVTED-SARLSWTAPDAAFDSFLIQYQESEKVGEAIVLTVPGS-ERSYDLT GLKPGTEYTVSIYGVKGGHRSNPL-SAIFTT), optionally having substitutions at residues positions 11, 14, 17, 37, 46, 73, or 86 (residue numbering corresponding to SEQ ID NO:4).

In some embodiments, an isolated FN3 domain that binds CD71 comprises the amino acid sequence of SEQ ID NOs: 273, 288-291, 301-310, 312-572, 592-599, or 708-710.

In some embodiments, proteins comprising a polypeptide comprising an amino acid sequence of SEQ ID NO: 273.

SEQ ID NO: 273 is a consensus sequence based on the sequences of SEQ ID NO: 288, SEQ ID NO: 289, SEQ ID NO: 290, and SEQ ID NO: 291. The sequence of SEQ ID NO: 273 is MLPAPKNLVVSRVTEDSARLSWTAPDAAFDSFX$_1$IX$_2$YX$_3$EX$_4$X$_5$X$_6$X$_7$GEAIX$_8$LX$_9$VPGSERSYDLTGLKPGTEYX$_{10}$VX$_{11}$IX$_{12}$X$_{13}$VKGGX$_{14}$X$_{15}$SX$_{16}$PLX$_{17}$AX$_{18}$FTT wherein X$_8$, X$_9$, X$_{17}$, and X$_{18}$ are each, independently, any amino acid other than methionine or proline, and X$_1$ is selected from D, F, Y, or H,
X$_2$ is selected from Y, G, A, or V,
X$_3$ is selected from I, T, L, A, or H,
X$_4$ is selected from S, Y or P,
X$_5$ is selected from Y, G, Q, or R,
X$_6$ is selected from G or P,
X$_7$ is selected from A, Y, P, D, or S,
X$_{10}$ is selected from W, N, S, or E,
X$_{11}$ is selected from L, Y, or G,
X$_{12}$ is selected from D, Q, H, or V,
X$_{13}$ is selected from G or S,
X$_{14}$ is selected from R, G, F, L, or D,
X$_{15}$ is selected from W, S, P, or L, and
X$_{16}$ is selected from T, V, M, or S.

In some embodiments:
X$_1$ is selected from D, F, Y, or H,
X$_2$ is selected from G, A, or V,
X$_3$ is selected from T, L, A, or H,
X$_4$ is selected from Y or P,
X$_5$ is selected from G, Q, or R,
X$_6$ is selected from G or P,
X$_7$ is selected from Y, P, D, or S,
X$_{10}$ is selected from W, N, S, or E,
X$_{11}$ is selected from L, Y, or G,
X$_{12}$ is selected from Q, H, or V,
X$_{13}$ is selected from G or S,
X$_{14}$ is selected from G, F, L, or D,
X$_{15}$ is selected from S, P, or L, and
X$_{16}$ is selected from V, M, or S.

In some embodiments, X$_1$, X$_2$, X$_3$, X$_4$, X$_5$, X$_6$, X$_7$, X$_{10}$, X$_{11}$, X$_{12}$, X$_{13}$, X$_{14}$, X$_{15}$, and X$_{16}$ are as shown in the sequence of SEQ ID NO: 288. In some embodiments, X$_1$, X$_2$, X$_3$, X$_4$, X$_5$, X$_6$, X$_7$, X$_{10}$, X$_{11}$, X$_{12}$, X$_{13}$, X$_{14}$, X$_{15}$, and X$_{16}$ are as shown in the sequence of SEQ ID NO: 289. In some embodiments, X$_1$, X$_2$, X$_3$, X$_4$, X$_5$, X$_6$, X$_7$, X$_{10}$, X$_{11}$, X$_{12}$, X$_{13}$, X$_{14}$, X$_{15}$, and X$_{16}$ are as shown in the sequence of SEQ ID NO: 290. In some embodiments, X$_1$, X$_2$, X$_3$, X$_4$, X$_5$, X$_6$, X$_7$, X$_{10}$, X$_{11}$, X$_{12}$, X$_{13}$, X$_{14}$, X$_{15}$, and X$_{16}$ are as shown in the sequence of SEQ ID NO: 291.

In some embodiments, X$_8$, X$_9$, X$_{17}$, and X$_{18}$ is, independently, alanine, arginine, asparagine, aspartic acid, cysteine, glutamine, glutamic acid, glycine, histidine, isoleucine, leucine, lysine, phenylalanine, serine, threonine, tryptophan, tyrosine, or valine. In some embodiments, X$_8$, X$_9$, X$_{17}$, and X$_{18}$ is, independently, not alanine, arginine, asparagine, aspartic acid, cysteine, glutamine, glutamic acid, glycine, histidine, isoleucine, leucine, lysine, phenylalanine, serine, threonine, tryptophan, tyrosine, or valine. In some embodiments, X$_8$, X$_9$, X$_{17}$, and X$_{18}$ is, independently, alanine. In some embodiments, X$_8$, X$_9$, X$_{17}$, and X$_{18}$ is, independently, arginine. In some embodiments, X$_8$, X$_9$, X$_{17}$, and X$_{18}$ is, independently asparagine. In some embodiments, X$_8$, X$_9$, X$_{17}$, and X$_{18}$ is, independently, aspartic acid. In some embodiments, X$_8$, X$_9$, X$_{17}$, and X$_{18}$ is, independently, cysteine. In some embodiments, X$_8$, X$_9$, X$_{17}$, and X$_{18}$ is, independently, glutamine. In some embodiments, X$_8$, X$_9$, X$_{17}$, and X$_{18}$ is, independently, glutamic acid. In some embodiments, X$_8$, X$_9$, X$_{17}$, and X$_{18}$ is, independently, glycine. In some embodiments, X$_8$, X$_9$, X$_{17}$, and X$_{18}$ is, independently, histidine. In some embodiments, X$_8$, X$_9$, X$_{17}$, and X$_{18}$ is, independently, isoleucine. In some embodiments, X$_8$, X$_9$, X$_{17}$, and X$_{18}$ is, independently, leucine. In some embodiments, X$_8$, X$_9$, X$_{17}$, and X$_{18}$ is, independently, lysine. In some embodiments, X$_8$, X$_9$, X$_{17}$, and X$_{18}$ is, independently, phenylalanine. In some embodiments, X$_8$, X$_9$, X$_{17}$, and X$_{18}$ is, independently serine. In some embodiments, X$_8$, X$_9$, X$_{17}$, and X$_{18}$ is, independently, threonine. In some embodiments, X$_8$, X$_9$, X$_{17}$, and X$_{18}$ is, independently, tryptophan. In some embodiments, X$_8$, X$_9$, X$_{17}$, and X$_{18}$ is, independently, tyrosine. In some embodiments, X$_8$, X$_9$, X$_{17}$, and X$_{18}$ is, independently, valine.

In some embodiments, the sequence is set forth as shown in in the sequence of SEQ ID NO: 288, except that the positions that correspond to the positions of X$_8$, X$_9$, X$_{17}$, and X$_{18}$ can be any other amino acid residue as set forth above, except that in some embodiments, X$_8$ is not V, X$_9$ is not T, X$_{17}$ is not S, and X$_{18}$ is not I.

In some embodiments, the sequence is set forth as shown in in the sequence of SEQ ID NO: 289, except that the positions that correspond to the positions of X$_8$, X$_9$, X$_{17}$, and X$_{18}$ can be any other amino acid residue as set forth above, except that in some embodiments, X$_8$ is not V, X$_9$ is not T, X$_{17}$ is not S, and X$_{18}$ is not I.

In some embodiments, the sequence is set forth as shown in in the sequence of SEQ ID NO: 290, except that the positions that correspond to the positions of X$_8$, X$_9$, X$_{17}$, and X$_{18}$ can be any other amino acid residue as set forth above, except that in some embodiments, X$_8$ is not V, X$_9$ is not T, X$_{17}$ is not S, and X$_{18}$ is not I.

In some embodiments, the sequence is set forth as shown in in the sequence of SEQ ID NO: 291, except that the positions that correspond to the positions of X$_8$, X$_9$, X$_{17}$, and X$_{18}$ can be any other amino acid residue as set forth above, except that in some embodiments, X$_8$ is not V, X$_9$ is not T, X$_{17}$ is not S, and X$_{18}$ is not I.

In some embodiments, proteins comprising a polypeptide comprising an amino acid sequence that is at least 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to a sequence of SEQ ID NO: 273. In some embodiments, the protein is at least 85%, 86%, 87%, 88%, 89%, 90%, 91%, 92%, 93%, 94%, 95%, 96%, 97%, 98% or 99% identical to a sequence of SEQ ID NO: 273. In some embodiments, the protein is at least 90%, 91%, 92%, 93%, 94%, 95%, 96%, 97%, 98% or 99% identical to a sequence of SEQ ID NO: 273. In some embodiments, the protein is at least 95%, 96%, 97%, 98% or 99% identical to a sequence of SEQ ID NO: 273.

Percent identity can be determined using the default parameters to align two sequences using BlastP available through the NCBI website.

In some embodiments, fibronectin type III (FN3) domains that bind or specifically bind human CD71 protein (SEQ ID Nos: 2 or 5) are provided. As provided herein, the FN3 domains can bind to the CD71 protein. Also provided, even if not explicitly stated is that the domains can also specifically bind to the CD71 protein. Thus, for example, a FN3 domain that binds to CD71 would also encompass a FN3 domain protein that specifically binds to CD71. These molecules can be used, for example, in therapeutic and diagnostic applications and in imaging. In some embodiments, polynucleotides encoding the FN3 domains disclosed herein or complementary nucleic acids thereof, vectors, host cells, and methods of making and using them are provided.

In some embodiments, an isolated FN3 domain that binds or specifically binds CD71 is provided.

In some embodiments, the FN3 domain comprises two FN3 domains connected by a linker. The linker can be a flexible linker. The linker can be a short peptide sequence, such as those described herein. For example, the linker can be a G/S linker and the like.

In some embodiments, the FN3 domain comprising two FN3 domains connected by a linker, such as those provided for herein. Exemplary linker include, but are not limited to, (GS)$_2$, (SEQ ID NO: 720), (GGGS)$_2$ (SEQ ID NO: 721), (GGGGS)$_{1-5}$ (SEQ ID NO: 1065), (AP)$_{1-20}$ (SEQ ID NO: 1066); (AP)$_2$ (SEQ ID NO: 723), (AP)$_5$ (SEQ ID NO: 724), (AP)$_{10}$ (SEQ ID NO: 725), (AP)$_{20}$ (SEQ ID NO: 726), A(EAAAK)$_5$AAA (SEQ ID NO: 727), or (EAAAK)$_{1-5}$ (SEQ ID NO: 728). In some embodiments, the linker comprises or is an amino acid sequence of: EAAAKEAAAKEAAAKEAAAK (SEQ ID NO: 729); GGGGSGGGGSGGGGSGGGGS (SEQ ID NO: 730); APAPAPAPAP (SEQ ID NO: 731); or EAAAK (SEQ ID NO: 732).

In some embodiments, the FN3 domain may bind CD71 with a dissociation constant (K$_D$) of less than about $1\times10^{-7}$M, for example less than about $1\times10^{-8}$M, less than about $1\times10^{-9}$M, less than about $1\times10^{-10}$ M, less than about $1\times10^{-11}$ M, less than about $1\times10^{-12}$ M, or less than about $1\times10^{-13}$ M as determined by surface plasmon resonance or the Kinexa method, as practiced by those of skill in the art. The measured affinity of a particular FN3 domain-antigen interaction can vary if measured under different conditions (e.g., osmolarity, pH). Thus, measurements of affinity and other antigen-binding parameters (e.g., K$_D$, K$_{on}$, K$_{off}$) are made with standardized solutions of protein scaffold and antigen, and a standardized buffer, such as the buffers described herein.

In some embodiments, the FN3 domain may bind CD71 at least 5-fold above the signal obtained for a negative control in a standard solution ELISA assay.

In some embodiments, the FN3 domain that binds or specifically binds CD71 comprises an initiator methionine (Met) linked to the N-terminus of the molecule. In some embodiments, the FN3 domain that binds or specifically binds CD71 comprises a cysteine (Cys) linked to a C-terminus of the FN3 domain. The addition of the N-terminal Met and/or the C-terminal Cys may facilitate expression and/or conjugation to extend half-life and to provide other functions of molecules.

The FN3 domain can also contain cysteine substitutions, such as those that are described in U.S. Pat. No. 10,196,446, which is hereby incorporated by reference in its entirety. Briefly, in some embodiments, the polypeptides provided herein can comprise at least one cysteine substitution at a position selected from the group consisting of residues 6, 8, 10, 11, 14, 15, 16, 20, 30, 34, 38, 40, 41, 45, 47, 48, 53, 54, 59, 60, 62, 64, 70, 88, 89, 90, 91, and 93 of the FN3 domain based on SEQ ID NO: 6 or SEQ ID NO: 1 of U.S. Pat. No. 10,196,446, and the equivalent positions in related FN3 domains. In some embodiments, the substitution is at residue 6. In some embodiments, the substitution is at residue 8. In some embodiments, the substitution is at residue 10. In some embodiments, the substitution is at residue 11. In some embodiments, the substitution is at residue 14. In some embodiments, the substitution is at residue 15. In some embodiments, the substitution is at residue 16. In some embodiments, the substitution is at residue 20. In some embodiments, the substitution is at residue 30. In some embodiments, the substitution is at residue 34. In some embodiments, the substitution is at residue 38. In some embodiments, the substitution is at residue 40. In some embodiments, the substitution is at residue 41. In some embodiments, the substitution is at residue 45. In some embodiments, the substitution is at residue 47. In some embodiments, the substitution is at residue 48. In some embodiments, the substitution is at residue 53. In some embodiments, the substitution is at residue 54. In some embodiments, the substitution is at residue 59. In some embodiments, the substitution is at residue 60. In some embodiments, the substitution is at residue 62. In some embodiments, the substitution is at residue 64. In some embodiments, the substitution is at residue 70. In some embodiments, the substitution is at residue 88. In some embodiments, the substitution is at residue 89. In some embodiments, the substitution is at residue 90. In some embodiments, the substitution is at residue 91. In some embodiments, the substitution is at residue 93.

A cysteine substitution at a position in the domain or protein comprises a replacement of the existing amino acid residue with a cysteine residue. In some embodiments, instead of a substitution a cysteine is inserted into the sequence adjacent to the positions listed above. Other examples of cysteine modifications can be found in, for example, U.S. Patent Application Publication No. 20170362301, which is hereby incorporated by reference in its entirety. The alignment of the sequences can be performed using BlastP using the default parameters at, for example, the NCBI website.

In some embodiments, a cysteine residue is inserted at any position in the domain or protein.

In some embodiments, the FN3 domain that binds CD71 is internalized into a cell. In some embodiments, internalization of the FN3 domain may facilitate delivery of a detectable label or therapeutic into a cell. In some embodiments, internalization of the FN3 domain may facilitate delivery of a cytotoxic agent into a cell. The cytotoxic agent can act as a therapeutic agent. In some embodiments, internalization of the FN3 domain may facilitate the delivery of any detectable label, therapeutic, and/or cytotoxic agent disclosed herein into a cell. In some embodiments, internalization of the FN3 domain may facilitate delivery of a oligonucleotide into a cell. In some embodiments, the cell is a tumor cell. In some embodiments, the cell is a liver cell. In some embodiments, the cell is a muscle cell. In some embodiments, the cell is an immune cell. In some embodiments, the cell is a dendritic cell. In some embodiments, the cell is a cell of the central nervous system. In some embodiments, the cell is a heart cell.

In some embodiments, an isolated FN3 domain that binds CD71 comprises the amino acid sequence of SEQ ID NOs: 273, 288-291, 301-310, 312-572, 592-599, or 708-710.

In some embodiments, an isolated FN3 domain that binds CD71 comprises the amino acid sequence of SEQ ID NO:301. In some embodiments, an isolated FN3 domain that binds CD71 comprises the amino acid sequence of SEQ ID NO:302. In some embodiments, an isolated FN3 domain that binds CD71 comprises the amino acid sequence of SEQ ID NO:303. In some embodiments, an isolated FN3 domain that binds CD71 comprises the amino acid sequence of SEQ ID NO:304. In some embodiments, an isolated FN3 domain that binds CD71 comprises the amino acid sequence of SEQ ID NO:305. In some embodiments, an isolated FN3 domain that binds CD71 comprises the amino acid sequence of SEQ ID NO:306. In some embodiments, an isolated FN3 domain that binds CD71 comprises the amino acid sequence of SEQ ID NO:307. In some embodiments, an isolated FN3 domain that binds CD71 comprises the amino acid sequence of SEQ ID NO:310. In some embodiments, an isolated FN3 domain that binds CD71 comprises the amino acid sequence of SEQ ID NO:312. In some embodiments, an isolated FN3 domain that binds CD71 comprises the amino acid sequence of SEQ ID NO:313. In some embodiments, an isolated FN3 domain that binds CD71 comprises the amino acid sequence of SEQ ID NO:314. In some embodiments, an isolated FN3 domain that binds CD71 comprises the amino acid sequence of SEQ ID NO:315. In some embodiments, an isolated FN3 domain that binds CD71 comprises the amino acid sequence of SEQ ID NO:316. In some embodiments, an isolated FN3 domain that binds CD71 comprises the amino acid sequence of SEQ ID NO:317. In some embodiments, an isolated FN3 domain that binds CD71 comprises the amino acid sequence of SEQ ID NO:318. In some embodiments, an isolated FN3 domain that binds CD71 comprises the amino acid sequence of SEQ ID NO:319. In some embodiments, an isolated FN3 domain that binds CD71 comprises the amino acid sequence of SEQ ID NO:320. In some embodiments, an isolated FN3 domain that binds CD71 comprises the amino acid sequence of SEQ ID NO:321. In some embodiments, an isolated FN3 domain that binds CD71 comprises the amino acid sequence of SEQ ID NO:322. In some embodiments, an isolated FN3 domain that binds CD71 comprises the amino acid sequence of SEQ ID NO:323. In some embodiments, an isolated FN3 domain that binds CD71 comprises the amino acid sequence of SEQ ID NO:324. In some embodiments, an isolated FN3 domain that binds CD71 comprises the amino acid sequence of SEQ ID NO:325. In some embodiments, an isolated FN3 domain that binds CD71 comprises the amino acid sequence of SEQ ID NO:326. In some embodiments, an isolated FN3 domain that binds CD71 comprises the amino acid sequence of SEQ ID NO:327. In some embodiments, an isolated FN3 domain that binds CD71 comprises the amino acid sequence of SEQ ID NO:328. In some embodiments, an isolated FN3 domain that binds CD71 comprises the amino acid sequence of SEQ ID NO:329. In some embodiments, an isolated FN3 domain that binds CD71 comprises the amino acid sequence of SEQ ID NO:330. In some embodiments, an isolated FN3 domain that binds CD71 comprises the amino acid sequence of SEQ ID NO:331. In some embodiments, an isolated FN3 domain that binds CD71 comprises the amino acid sequence of SEQ ID NO:332. In some embodiments, an isolated FN3 domain that binds CD71 comprises the amino acid sequence of SEQ ID NO:333. In some embodiments, an isolated FN3 domain that binds CD71 comprises the amino acid sequence of SEQ ID NO:334. In some embodiments, an isolated FN3 domain that binds CD71 comprises the amino acid sequence of SEQ ID NO:335. In some embodiments, an isolated FN3 domain that binds CD71 comprises the amino acid sequence of SEQ ID NO:336. In some embodiments, an isolated FN3 domain that binds CD71 comprises the amino acid sequence of SEQ ID NO:337. In some embodiments, an isolated FN3 domain that binds CD71 comprises the amino acid sequence of SEQ ID NO:338. In some embodiments, an isolated FN3 domain that binds CD71 comprises the amino acid sequence of SEQ ID NO:339. In some embodiments, an isolated FN3 domain that binds CD71 comprises the amino acid sequence of SEQ ID NO:340. In some embodiments, an isolated FN3 domain that binds CD71 comprises the amino acid sequence of SEQ ID NO:341. In some embodiments, an isolated FN3 domain that binds CD71 comprises the amino acid sequence of SEQ ID NO:342. In some embodiments, an isolated FN3 domain that binds CD71 comprises the amino acid sequence of SEQ ID NO:343. In some embodiments, an isolated FN3 domain that binds CD71 comprises the amino acid sequence of SEQ ID NO:344. In some embodiments, an isolated FN3 domain that binds CD71 comprises the amino acid sequence of SEQ ID NO:345. In some embodiments, an isolated FN3 domain that binds CD71 comprises the amino acid sequence of SEQ ID NO:346. In some embodiments, an isolated FN3 domain that binds CD71 comprises the amino acid sequence of SEQ ID NO:347. In some embodiments, an isolated FN3 domain that binds CD71 comprises the amino acid sequence of SEQ ID NO:348. In some embodiments, an isolated FN3 domain that binds CD71 comprises the amino acid sequence of SEQ ID NO:349. In some embodiments, an isolated FN3 domain that binds CD71 comprises the amino acid sequence of SEQ ID NO:350. In some embodiments, an isolated FN3 domain that binds CD71 comprises the amino acid sequence of SEQ ID NO:351. In some embodiments, an isolated FN3 domain that binds CD71 comprises the amino acid sequence of SEQ ID NO:352. In some embodiments, an isolated FN3 domain that binds CD71 comprises the amino acid sequence of SEQ ID NO:353. In some embodiments, an isolated FN3 domain that binds CD71 comprises the amino acid sequence of SEQ ID NO:354. In some embodiments, an isolated FN3 domain that binds CD71 comprises the amino acid sequence of SEQ ID NO:355. In some embodiments, an isolated FN3 domain that binds CD71 comprises the amino acid sequence of SEQ ID NO:356. In some embodiments, an isolated FN3 domain that binds CD71 comprises the amino acid sequence of SEQ ID NO:357. In some embodiments, an isolated FN3 domain that binds CD71 comprises the amino acid sequence of SEQ ID NO:358. In some embodiments, an isolated FN3 domain that binds CD71 comprises the amino acid sequence of SEQ ID NO:359. In some embodiments, an isolated FN3 domain that binds CD71 comprises the amino acid sequence of SEQ ID NO:360. In some embodiments, an isolated FN3 domain that binds CD71 comprises the amino acid sequence of SEQ ID NO:361. In some embodiments, an isolated FN3 domain that binds CD71 comprises the amino acid sequence of SEQ ID NO:362. In some embodiments, an isolated FN3 domain that binds CD71 comprises the amino acid sequence of SEQ ID NO:363. In some embodiments, an isolated FN3 domain that binds CD71 comprises the amino acid sequence of SEQ ID NO:364. In some embodiments, an isolated FN3 domain that binds CD71 comprises the amino acid sequence of SEQ ID NO:365. In some embodiments, an isolated FN3 domain that binds CD71 comprises the amino acid sequence of SEQ ID NO:366. In some embodiments, an isolated FN3 domain that binds CD71 comprises the amino acid sequence of SEQ ID NO:367. In some embodiments, an isolated FN3 domain that binds CD71 comprises the amino acid sequence of SEQ ID NO:368. In some embodiments, an isolated FN3 domain that binds CD71 comprises the amino acid sequence of SEQ ID NO:369. In some embodiments, an isolated FN3 domain that binds CD71 comprises the amino acid sequence of SEQ ID NO:370. In some embodiments, an isolated FN3 domain that binds CD71 comprises the amino acid sequence of SEQ ID NO:371. In some embodiments, an isolated FN3 domain that binds CD71 comprises the amino acid sequence of SEQ ID NO:372. In some embodiments, an isolated FN3 domain that binds CD71 comprises the amino acid sequence of SEQ ID NO:373. In some embodiments, an isolated FN3 domain that binds CD71 comprises the amino acid sequence of SEQ ID NO:374. In some embodiments, an isolated FN3 domain that binds CD71 comprises the amino acid sequence of SEQ ID NO:375. In some embodiments, an isolated FN3 domain that binds CD71 comprises the amino acid sequence of SEQ ID NO:376. In some embodiments, an isolated FN3 domain that binds CD71 comprises the amino acid sequence of SEQ ID NO:377. In some embodiments, an isolated FN3 domain that binds CD71 comprises the amino acid sequence of SEQ ID NO:378. In some embodiments, an isolated FN3 domain that binds CD71 comprises the amino acid sequence of SEQ ID NO:379. In some embodiments, an isolated FN3 domain that binds CD71 comprises the amino acid sequence of SEQ ID NO:380. In some embodiments, an isolated FN3 domain that binds CD71 comprises the amino acid sequence of SEQ ID NO:381. In some embodiments, an isolated FN3 domain that binds CD71 comprises the amino acid sequence of SEQ ID NO:382. In some embodiments, an isolated FN3 domain that binds CD71 comprises the amino acid sequence of SEQ ID NO:383. In some embodiments, an isolated FN3 domain that binds CD71 comprises the amino acid sequence of SEQ ID NO:384. In some embodiments, an isolated FN3 domain that binds CD71 comprises the amino acid sequence of SEQ ID NO:385. In some embodiments, an isolated FN3 domain that binds CD71 comprises the amino acid sequence of SEQ ID NO:386. In some embodiments, an isolated FN3 domain that binds CD71 comprises the amino acid sequence of SEQ ID NO:387. In some embodiments, an isolated FN3 domain that binds CD71 comprises the amino acid sequence of SEQ ID NO:388. In some embodiments, an isolated FN3 domain that binds CD71 comprises the amino acid sequence of SEQ ID NO:389. In some embodiments, an isolated FN3 domain that binds CD71 comprises the amino acid sequence of SEQ ID NO:390. In some embodiments, an isolated FN3 domain that binds CD71 comprises the amino acid sequence of SEQ ID NO:391. In some embodiments, an isolated FN3 domain that binds CD71 comprises the amino acid sequence of SEQ ID NO:392. In some embodiments, an isolated FN3 domain that binds CD71 comprises the amino acid sequence of SEQ ID NO:393. In some embodiments, an isolated FN3 domain that binds CD71 comprises the amino acid sequence of SEQ ID NO:394. In some embodiments, an isolated FN3 domain that binds CD71 comprises the amino acid sequence of SEQ ID NO: 395. In some embodiments, an isolated FN3 domain that binds CD71 comprises the amino acid sequence of SEQ ID NO: 396. In some embodiments, an isolated FN3 domain that binds CD71 comprises the amino acid sequence of SEQ ID NO: 397. In some embodiments, an isolated FN3 domain that binds CD71 comprises the amino acid sequence of SEQ ID NO: 398. In some embodiments, an isolated FN3 domain that binds CD71 comprises the amino acid sequence of SEQ ID NO: 399. In some embodiments, an isolated FN3 domain that binds CD71 comprises the amino acid sequence of SEQ ID NO: 400. In some embodiments, an isolated FN3 domain that binds CD71 comprises the amino acid sequence of SEQ ID NO: 401. In some embodiments, an isolated FN3 domain that binds CD71 comprises the amino acid sequence of SEQ ID NO: 402. In some embodiments, an isolated FN3 domain that binds CD71 comprises the amino acid sequence of SEQ ID NO: 403. In some embodiments, an isolated FN3 domain that binds CD71 comprises the amino acid sequence of SEQ ID NO: 404. In some embodiments, an isolated FN3 domain that binds CD71 comprises the amino acid sequence of SEQ ID NO: 405. In some embodiments, an isolated FN3 domain that binds CD71 comprises the amino acid sequence of SEQ ID NO: 406. In some embodiments, an isolated FN3 domain that binds CD71 comprises the amino acid sequence of SEQ ID NO: 407. In some embodiments, an isolated FN3 domain that binds CD71 comprises the amino acid sequence of SEQ ID NO: 408. In some embodiments, an isolated FN3 domain that binds CD71 comprises the amino acid sequence of SEQ ID NO: 409. In some embodiments, an isolated FN3 domain that binds CD71 comprises the amino acid sequence of SEQ ID NO: 410. In some embodiments, an isolated FN3 domain that binds CD71 comprises the amino acid sequence of SEQ ID NO: 411. In some embodiments, an isolated FN3 domain that binds CD71 comprises the amino acid sequence of SEQ ID NO: 412. In some embodiments, an isolated FN3 domain that binds CD71 comprises the amino acid sequence of SEQ ID NO: 413. In some embodiments, an isolated FN3 domain that binds CD71 comprises the amino acid sequence of SEQ ID NO: 414. In some embodiments, an isolated FN3 domain that binds CD71 comprises the amino acid sequence of SEQ ID NO: 415. In some embodiments, an isolated FN3 domain that binds CD71 comprises the amino acid sequence of SEQ ID NO: 416. In some embodiments, an isolated FN3 domain that binds CD71 comprises the amino acid sequence of SEQ ID NO: 417. In some embodiments, an isolated FN3 domain that binds CD71 comprises the amino acid sequence of SEQ ID NO: 418. In some embodiments, an isolated FN3 domain that binds CD71 comprises the amino acid sequence of SEQ ID NO: 419. In some embodiments, an isolated FN3 domain that binds CD71 comprises the amino acid sequence of SEQ ID NO: 420. In some embodiments, an isolated FN3 domain that binds CD71 comprises the amino acid sequence of SEQ ID NO: 421. In some embodiments, an isolated FN3 domain that binds CD71 comprises the amino acid sequence of SEQ ID NO: 422. In some embodiments, an isolated FN3 domain that binds CD71 comprises the amino acid sequence of SEQ ID NO: 423. In some embodiments, an isolated FN3 domain that binds CD71 comprises the amino acid sequence of SEQ ID NO: 424. In some embodiments, an isolated FN3 domain that binds CD71 comprises the amino acid sequence of SEQ ID NO: 425. In some embodiments, an isolated FN3 domain that binds CD71 comprises the amino acid sequence of SEQ ID NO: 426. In some embodiments, an isolated FN3 domain that binds CD71 comprises the amino acid sequence of SEQ ID NO: 427. In some embodiments, an isolated FN3 domain that binds CD71 comprises the amino acid sequence of SEQ ID NO: 428. In some embodiments, an isolated FN3 domain that binds CD71 comprises the amino acid sequence of SEQ ID NO: 429. In some embodiments, an isolated FN3 domain that binds CD71 comprises the amino acid sequence of SEQ ID NO: 430. In some embodiments, an isolated FN3 domain that binds CD71 comprises the amino acid sequence of SEQ ID NO: 431. In some embodiments, an isolated FN3 domain that binds CD71 comprises the amino acid sequence of SEQ ID NO: 432. In some embodiments, an isolated FN3 domain that binds CD71 comprises the amino acid sequence of SEQ ID NO: 433. In some embodiments, an isolated FN3 domain that binds CD71 comprises the amino acid sequence of SEQ ID NO: 434. In some embodiments, an isolated FN3 domain that binds CD71 comprises the amino acid sequence of SEQ ID NO: 435. In some embodiments, an isolated FN3 domain that binds CD71 comprises the amino acid sequence of SEQ ID NO: 436. In some embodiments, an isolated FN3 domain that binds CD71 comprises the amino acid sequence of SEQ ID NO: 437. In some embodiments, an isolated FN3 domain that binds CD71 comprises the amino acid sequence of SEQ ID NO: 438. In some embodiments, an isolated FN3 domain that binds CD71 comprises the amino acid sequence of SEQ ID NO: 439. In some embodiments, an isolated FN3 domain that binds CD71 comprises the amino acid sequence of SEQ ID NO: 440. In some embodiments, an isolated FN3 domain that binds CD71 comprises the amino acid sequence of SEQ ID NO: 441. In some embodiments, an isolated FN3 domain that binds CD71 comprises the amino acid sequence of SEQ ID NO: 442. In some embodiments, an isolated FN3 domain that binds CD71 comprises the amino acid sequence of SEQ ID NO: 443. In some embodiments, an isolated FN3 domain that binds CD71 comprises the amino acid sequence of SEQ ID NO: 444. In some embodiments, an isolated FN3 domain that binds CD71 comprises the amino acid sequence of SEQ ID NO: 445. In some embodiments, an isolated FN3 domain that binds CD71 comprises the amino acid sequence of SEQ ID NO: 446. In some embodiments, an isolated FN3 domain that binds CD71 comprises the amino acid sequence of SEQ ID NO: 447. In some embodiments, an isolated FN3 domain that binds CD71 comprises the amino acid sequence of SEQ ID NO: 448. In some embodiments, an isolated FN3 domain that binds CD71 comprises the amino acid sequence of SEQ ID NO: 449. In some embodiments, an isolated FN3 domain that binds CD71 comprises the amino acid sequence of SEQ ID NO: 450. In some embodiments, an isolated FN3 domain that binds CD71 comprises the amino acid sequence of SEQ ID NO: 451. In some embodiments, an isolated FN3 domain that binds CD71 comprises the amino acid sequence of SEQ ID NO: 452. In some embodiments, an isolated FN3 domain that binds CD71 comprises the amino acid sequence of SEQ ID NO: 453. In some embodiments, an isolated FN3 domain that binds CD71 comprises the amino acid sequence of SEQ ID NO: 454. In some embodiments, an isolated FN3 domain that binds CD71 comprises the amino acid sequence of SEQ ID NO: 455. In some embodiments, an isolated FN3 domain that binds CD71 comprises the amino acid sequence of SEQ ID NO: 456. In some embodiments, an isolated FN3 domain that binds CD71 comprises the amino acid sequence of SEQ ID NO: 457. In some embodiments, an isolated FN3 domain that binds CD71 comprises the amino acid sequence of SEQ ID NO: 458. In some embodiments, an isolated FN3 domain that binds CD71 comprises the amino acid sequence of SEQ ID NO: 459. In some embodiments, an isolated FN3 domain that binds CD71 comprises the amino acid sequence of SEQ ID NO: 460. In some embodiments, an isolated FN3 domain that binds CD71 comprises the amino acid sequence of SEQ ID NO: 461. In some embodiments, an isolated FN3 domain that binds CD71 comprises the amino acid sequence of SEQ ID NO: 462. In some embodiments, an isolated FN3 domain that binds CD71 comprises the amino acid sequence of SEQ ID NO: 463. In some embodiments, an isolated FN3 domain that binds CD71 comprises the amino acid sequence of SEQ ID NO: 464. In some embodiments, an isolated FN3 domain that binds CD71 comprises the amino acid sequence of SEQ ID NO: 465. In some embodiments, an isolated FN3 domain that binds CD71 comprises the amino acid sequence of SEQ ID NO: 466. In some embodiments, an isolated FN3 domain that binds CD71 comprises the amino acid sequence of SEQ ID NO: 467. In some embodiments, an isolated FN3 domain that binds CD71 comprises the amino acid sequence of SEQ ID NO: 468. In some embodiments, an isolated FN3 domain that binds CD71 comprises the amino acid sequence of SEQ ID NO: 469. In some embodiments, an isolated FN3 domain that binds CD71 comprises the amino acid sequence of SEQ ID NO: 470. In some embodiments, an isolated FN3 domain that binds CD71 comprises the amino acid sequence of SEQ ID NO: 471. In some embodiments, an isolated FN3 domain that binds CD71 comprises the amino acid sequence of SEQ ID NO: 472. In some embodiments, an isolated FN3 domain that binds CD71 comprises the amino acid sequence of SEQ ID NO: 473. In some embodiments, an isolated FN3 domain that binds CD71 comprises the amino acid sequence of SEQ ID NO: 474. In some embodiments, an isolated FN3 domain that binds CD71 comprises the amino acid sequence of SEQ ID NO: 475. In some embodiments, an isolated FN3 domain that binds CD71 comprises the amino acid sequence of SEQ ID NO: 476. In some embodiments, an isolated FN3 domain that binds CD71 comprises the amino acid sequence of SEQ ID NO: 477. In some embodiments, an isolated FN3 domain that binds CD71 comprises the amino acid sequence of SEQ ID NO: 478. In some embodiments, an isolated FN3 domain that binds CD71 comprises the amino acid sequence of SEQ ID NO: 479. In some embodiments, an isolated FN3 domain that binds CD71 comprises the amino acid sequence of SEQ ID NO: 480. In some embodiments, an isolated FN3 domain that binds CD71 comprises the amino acid sequence of SEQ ID NO: 481. In some embodiments, an isolated FN3 domain that binds CD71 comprises the amino acid sequence of SEQ ID NO: 482. In some embodiments, an isolated FN3 domain that binds CD71 comprises the amino acid sequence of SEQ ID NO: 483. In some embodiments, an isolated FN3 domain that binds CD71 comprises the amino acid sequence of SEQ ID NO: 484. In some embodiments, an isolated FN3 domain that binds CD71 comprises the amino acid sequence of SEQ ID NO: 485. In some embodiments, an isolated FN3 domain that binds CD71 comprises the amino acid sequence of SEQ ID NO: 486. In some embodiments, an isolated FN3 domain that binds CD71 comprises the amino acid sequence of SEQ ID NO: 487. In some embodiments, an isolated FN3 domain that binds CD71 comprises the amino acid sequence of SEQ ID NO: 488. In some embodiments, an isolated FN3 domain that binds CD71 comprises the amino acid sequence of SEQ ID NO: 489. In some embodiments, an isolated FN3 domain that binds CD71 comprises the amino acid sequence of SEQ ID NO: 490. In some embodiments, an isolated FN3 domain that binds CD71 comprises the amino acid sequence of SEQ ID NO: 491. In some embodiments, an isolated FN3 domain that binds CD71 comprises the amino acid sequence of SEQ ID NO: 492. In some embodiments, an isolated FN3 domain that binds CD71 comprises the amino acid sequence of SEQ ID NO: 493. In some embodiments, an isolated FN3 domain that binds CD71 comprises the amino acid sequence of SEQ ID NO: 494. In some embodiments, an isolated FN3 domain that binds CD71 comprises the amino acid sequence of SEQ ID NO: 495. In some embodiments, an isolated FN3 domain that binds CD71 comprises the amino acid sequence of SEQ ID NO: 496. In some embodiments, an isolated FN3 domain that binds CD71 comprises the amino acid sequence of SEQ ID NO: 497. In some embodiments, an isolated FN3 domain that binds CD71 comprises the amino acid sequence of SEQ ID NO: 498. In some embodiments, an isolated FN3 domain that binds CD71 comprises the amino acid sequence of SEQ ID NO: 499. In some embodiments, an isolated FN3 domain that binds CD71 comprises the amino acid sequence of SEQ ID NO: 500. In some embodiments, an isolated FN3 domain that binds CD71 comprises the amino acid sequence of SEQ ID NO: 501. In some embodiments, an isolated FN3 domain that binds CD71 comprises the amino acid sequence of SEQ ID NO: 502. In some embodiments, an isolated FN3 domain that binds CD71 comprises the amino acid sequence of SEQ ID NO: 503. In some embodiments, an isolated FN3 domain that binds CD71 comprises the amino acid sequence of SEQ ID NO: 504. In some embodiments, an isolated FN3 domain that binds CD71 comprises the amino acid sequence of SEQ ID NO: 505. In some embodiments, an isolated FN3 domain that binds CD71 comprises the amino acid sequence of SEQ ID NO: 506. In some embodiments, an isolated FN3 domain that binds CD71 comprises the amino acid sequence of SEQ ID NO: 507. In some embodiments, an isolated FN3 domain that binds CD71 comprises the amino acid sequence of SEQ ID NO: 508. In some embodiments, an isolated FN3 domain that binds CD71 comprises the amino acid sequence of SEQ ID NO: 509. In some embodiments, an isolated FN3 domain that binds CD71 comprises the amino acid sequence of SEQ ID NO: 510. In some embodiments, an isolated FN3 domain that binds CD71 comprises the amino acid sequence of SEQ ID NO: 511. In some embodiments, an isolated FN3 domain that binds CD71 comprises the amino acid sequence of SEQ ID NO: 512. In some embodiments, an isolated FN3 domain that binds CD71 comprises the amino acid sequence of SEQ ID NO: 513. In some embodiments, an isolated FN3 domain that binds CD71 comprises the amino acid sequence of SEQ ID NO: 514. In some embodiments, an isolated FN3 domain that binds CD71 comprises the amino acid sequence of SEQ ID NO: 515. In some embodiments, an isolated FN3 domain that binds CD71 comprises the amino acid sequence of SEQ ID NO: 516. In some embodiments, an isolated FN3 domain that binds CD71 comprises the amino acid sequence of SEQ ID NO: 517. In some embodiments, an isolated FN3 domain that binds CD71 comprises the amino acid sequence of SEQ ID NO: 518. In some embodiments, an isolated FN3 domain that binds CD71 comprises the amino acid sequence of SEQ ID NO: 519. In some embodiments, an isolated FN3 domain that binds CD71 comprises the amino acid sequence of SEQ ID NO: 521. In some embodiments, an isolated FN3 domain that binds CD71 comprises the amino acid sequence of SEQ ID NO: 522. In some embodiments, an isolated FN3 domain that binds CD71 comprises the amino acid sequence of SEQ ID NO: 523. In some embodiments, an isolated FN3 domain that binds CD71 comprises the amino acid sequence of SEQ ID NO: 524. In some embodiments, an isolated FN3 domain that binds CD71 comprises the amino acid sequence of SEQ ID NO: 525. In some embodiments, an isolated FN3 domain that binds CD71 comprises the amino acid sequence of SEQ ID NO: 526. In some embodiments, an isolated FN3 domain that binds CD71 comprises the amino acid sequence of SEQ ID NO: 527. In some embodiments, an isolated FN3 domain that binds CD71 comprises the amino acid sequence of SEQ ID NO: 528. In some embodiments, an isolated FN3 domain that binds CD71 comprises the amino acid sequence of SEQ ID NO: 529. In some embodiments, an isolated FN3 domain that binds CD71 comprises the amino acid sequence of SEQ ID NO: 530. In some embodiments, an isolated FN3 domain that binds CD71 comprises the amino acid sequence of SEQ ID NO: 531. In some embodiments, an isolated FN3 domain that binds CD71 comprises the amino acid sequence of SEQ ID NO: 532. In some embodiments, an isolated FN3 domain that binds CD71 comprises the amino acid sequence of SEQ ID NO: 533. In some embodiments, an isolated FN3 domain that binds CD71 comprises the amino acid sequence of SEQ ID NO: 534. In some embodiments, an isolated FN3 domain that binds CD71 comprises the amino acid sequence of SEQ ID NO: 535. In some embodiments, an isolated FN3 domain that binds CD71 comprises the amino acid sequence of SEQ ID NO: 536. In some embodiments, an isolated FN3 domain that binds CD71 comprises the amino acid sequence of SEQ ID NO: 537. In some embodiments, an isolated FN3 domain that binds CD71 comprises the amino acid sequence of SEQ ID NO: 538. In some embodiments, an isolated FN3 domain that binds CD71 comprises the amino acid sequence of SEQ ID NO: 539. In some embodiments, an isolated FN3 domain that binds CD71 comprises the amino acid sequence of SEQ ID NO: 540. In some embodiments, an isolated FN3 domain that binds CD71 comprises the amino acid sequence of SEQ ID NO: 541. In some embodiments, an isolated FN3 domain that binds CD71 comprises the amino acid sequence of SEQ ID NO: 542. In some embodiments, an isolated FN3 domain that binds CD71 comprises the amino acid sequence of SEQ ID NO: 543. In some embodiments, an isolated FN3 domain that binds CD71 comprises the amino acid sequence of SEQ ID NO: 544. In some embodiments, an isolated FN3 domain that binds CD71 comprises the amino acid sequence of SEQ ID NO: 545. In some embodiments, an isolated FN3 domain that binds CD71 comprises the amino acid sequence of SEQ ID NO: 546. In some embodiments, an isolated FN3 domain that binds CD71 comprises the amino acid sequence of SEQ ID NO: 547. In some embodiments, an isolated FN3 domain that binds CD71 comprises the amino acid sequence of SEQ ID NO: 548. In some embodiments, an isolated FN3 domain that binds CD71 comprises the amino acid sequence of SEQ ID NO: 549. In some embodiments, an isolated FN3 domain that binds CD71 comprises the amino acid sequence of SEQ ID NO: 550. In some embodiments, an isolated FN3 domain that binds CD71 comprises the amino acid sequence of SEQ ID NO: 551. In some embodiments, an isolated FN3 domain that binds CD71 comprises the amino acid sequence of SEQ ID NO: 552. In some embodiments, an isolated FN3 domain that binds CD71 comprises the amino acid sequence of SEQ ID NO: 553. In some embodiments, an isolated FN3 domain that binds CD71 comprises the amino acid sequence of SEQ ID NO: 554. In some embodiments, an isolated FN3 domain that binds CD71 comprises the amino acid sequence of SEQ ID NO: 555. In some embodiments, an isolated FN3 domain that binds CD71 comprises the amino acid sequence of SEQ ID NO: 556. In some embodiments, an isolated FN3 domain that binds CD71 comprises the amino acid sequence of SEQ ID NO: 557. In some embodiments, an isolated FN3 domain that binds CD71 comprises the amino acid sequence of SEQ ID NO: 558. In some embodiments, an isolated FN3 domain that binds CD71 comprises the amino acid sequence of SEQ ID NO: 559. In some embodiments, an isolated FN3 domain that binds CD71 comprises the amino acid sequence of SEQ ID NO: 560. In some embodiments, an isolated FN3 domain that binds CD71 comprises the amino acid sequence of SEQ ID NO: 561. In some embodiments, an isolated FN3 domain that binds CD71 comprises the amino acid sequence of SEQ ID NO: 562. In some embodiments, an isolated FN3 domain that binds CD71 comprises the amino acid sequence of SEQ ID NO: 563. In some embodiments, an isolated FN3 domain that binds CD71 comprises the amino acid sequence of SEQ ID NO: 564. In some embodiments, an isolated FN3 domain that binds CD71 comprises the amino acid sequence of SEQ ID NO: 565. In some embodiments, an isolated FN3 domain that binds CD71 comprises the amino acid sequence of SEQ ID NO: 566. In some embodiments, an isolated FN3 domain that binds CD71 comprises the amino acid sequence of SEQ ID NO: 567. In some embodiments, an isolated FN3 domain that binds CD71 comprises the amino acid sequence of SEQ ID NO: 568. In some embodiments, an isolated FN3 domain that binds CD71 comprises the amino acid sequence of SEQ ID NO: 569. In some embodiments, an isolated FN3 domain that binds CD71 comprises the amino acid sequence of SEQ ID NO: 570. In some embodiments, an isolated FN3 domain that binds CD71 comprises the amino acid sequence of SEQ ID NO: 571. In some embodiments, an isolated FN3 domain that binds CD71 comprises the amino acid sequence of SEQ ID NO: 572. In some embodiments, an isolated FN3 domain that binds CD71 comprises the amino acid sequence of SEQ ID NO: 708. In some embodiments, an isolated FN3 domain that binds CD71 comprises the amino acid sequence of SEQ ID NO: 709. In some embodiments, an isolated FN3 domain that binds CD71 comprises the amino acid sequence of SEQ ID NO: 710.

In some embodiments, the isolated FN3 domain that binds CD71 comprises an initiator methionine (Met) linked to the N-terminus of the molecule.

In some embodiments, the isolated FN3 domain that binds CD71 comprises an amino acid sequence that is 62%, 63%, 64%, 65%, 66%, 67%, 68%, 69%, 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98% or 99% identical to one of the amino acid sequences of SEQ ID NOs: 273, 288-291, 301-310, 312-572, 592-599, or 708-710. Percent identity can be determined using the default parameters to align two sequences using BlastP available through the NCBI website. The sequences of the FN3 domains that bind to CD71 can be found, for example, in Table 4.

TABLE 4

CD71-binding FN3 domain sequences

| SEQ ID | Amino Acid sequence of FN3 domains that bind to CD71 |
|---|---|
| 301 | MLPAPKNLVVSRVTEDSARLSWTAPDAAFDSFPITYIEAVVLGEAIVLTVPGSERSYDLTGLKPGTEYPVGISGVKGGHNSMPLSAIFTT |
| 302 | MLPAPKNLVVSEVTEDSARLSWQGVARAFDSFMINYSELFWMGEAIVLTVPGSERSYDLTGLKPGTEYVVRIKGVKGGKGSWPLHAHFTT |
| 303 | MLPAPKNLVVSRVTEDSARLSWTAPDAAFDSFNIEYAETRWYGEAIVLTVPGSERSYDLTGLKPGTEYVVPIDGVKGGIASKPLSAIFTT |
| 304 | MLPAPKNLVVSEVTEDSARLSWQGVARAFDSFLITYRDQIFAGEVIVLTVPGSERSYDLTGLKPGTEYPVWIQGVKGGSPSAPLSAESTT |
| 305 | MLPAPKNLVVSEVTEDSARLSWQGVARAFDSFLITYREQIFAGEVIVLTVPGSERSYDLTGLKPGTEYWVYIWGVKGGKPSFPLRAGFTT |
| 306 | MLPAPKNLVVSRVTEDSARLSWTAPDAAFDSFPIIYMETFSRGEAIVLTVPGSERSYDLTGLKPGTEYRVPIGGVKGGSSSCPLSAIFTT |
| 307 | MLPAPKNLVVSDVTEDSARLSWQGVARAFDSFLITYREQIFAGEVIVLTVPGSERSYDLTGLKPGTEYPVWIQGVKGGSPSAPLSAEFTT |
| 310 | MLPAPKNLVVSRVTEDSARLSWTAPDAAFDSFKIAYIETATRGEAIVLTVPGSERSYDLTGLKPGTEYVVPIPGVKGGNTSSPLSAIFTT |
| 312 | MLPAPKNLVVSRVTEDSARLSWTAPDAAFDSFFIPYAEPSPTGEAIVLTVPGSERSYDLTGLKPGTEYSVLIHGVKGGHLSDPLSAISTT |
| 313 | MLPAPKNLVVSRVTEDSARLSWTAPDAAFDSFLIAYPEDGFRGEAIVLTVPGSERSYDLTGLKPGTEYPVPILGVKGGGGSGPLSAIFTT |
| 314 | MLPAPKNLVVSRVTEDSARLSWTAPDAAFDSFPIYYVENVVWGEAIVLTVPGSERSYDLTGLKPGTEYWEVIIGVKGGQCSRPLSAIFTT |
| 315 | MLPAPKNLVVSRVTEDSARLSWQGVARAFDSFLITYREQIFAGEVIVLTVPGSERSYDLTGLKPGTECPVWIQGVKGGSPSAPLSAEFTT |
| 316 | MLPAPKNLVVSRVTEDSARLSWTAPDAAFDSFGIAYREFRPSGEAIVLTVPGSERSYDLTVETGYRNEVVICGVKGGPWSGPLSAIFTT |
| 317 | MLPAPKNLVVSRVTEDSARLSWTAPDAAFDSFPILYTECVYRGEAIVLTVPGSERSYDLTGLKPGTEYHVPITGVKGGGGSWPLSAIFTT |
| 318 | MLPAPKNLVVSRVTEDSARLSWTAPDAAFDSFNIMYHEIIYVGEAIVLTVPGSERSYDLTGLKPGTEYPVPIEGVKGGGTSGPLSAIFTT |
| 319 | MLPAPKNLVVSRVTEDSARLSWTAPDAAFDSFAITYTEAALCGEAIVLTVPGSERSYDLTGLKPGTEYPVPINGVKGGGTSGPLSAIFTT |
| 320 | MLPAPKNLVVARVTEDSARLSWTAPDAAIDSFPIDYSEYWWGGEAIVLTVPGSERSYDLTGLKPGTEYPVLITGVKGGYRSGPLSAIFTT |
| 321 | MLPAPKNLVVSRVTEDSARLSWTAPDAAFDSFSIRYNEFIVAGEAIVLTVPGSERSYDLTGLKPGTEYDVPIAGVKGGGASWPLSAIVTT |
| 322 | MLPAPKNLVVSRVTEDSARLSWTAPDAAFDSFWYLELQFAGEAIVLTVPGSERSYDLTGLKPGTEYNVPITGVKGGIISFPLSAIFTT |
| 323 | MLPAPKNLVVSRVTEDSARLSWTAPDAAFDSFAIWYHEWYGDGEAIVLTVPGSERSYDLTGPKPGTEYRVRISGVKGGFESGPLSAIFTT |
| 324 | MLPAPKNLVVSRVTEDSARLSWTAPDAAFDSFMIRYQEGTRWGEAIVLTVPGSERSYDLTGLKPGTEYIVMIAGVKGGQISLPLSAIFTT |
| 325 | MLPAPKNLVVSRVTEDSARLSWTAPDAAFDSFPIWYLEKSYQGEAIVLTVPGSERSYDLTGLKPGTEYVVPIIGVKGGRDSCPLSAIFTT |
| 326 | MLPAPKNLVVSEVTEDSARLSWQGVARAFDSFLITYREQIFAGEVIVLTVPGSERSYDLTGLKPGTEYPVWIQGVKGGSPSAPLSAEFTT |

TABLE 4-continued

CD71-binding FN3 domain sequences

SEQ
ID  Amino Acid sequence of FN3 domains that bind to CD71

327 MLPAPKNLVVSRVTEDSARLSWTAPDAAFDSFRISYAETVRQGEAIVLTVPGSE
    RSYDLTVETGYRNWVMILGVKGGPGSLPLSAIFTT

328 MLPAPKNLVVSEVTEDSARLSWQGVVRAFDSFLITYREQIFAGEVIVLTVPGSE
    RSYDLTGLKPGTEYPVWIQGVKGGSPSAPLSAEFTT

329 MLPAPKNLVVSRVTEDSARLSWTAPDAAFDSFWIEYWEAVGFGEAIVLTVPGS
    ERSYDLTGLKPGTEYFVGIYGVKGGYLSAPLSAIFTT

330 MLPAPKNLVVSRVTEDSARLSWTAPDAAFDSFIIHYVEQQLIGEAIVLTVPGSE
    RSYDLTGLKPGTEYPVPITGVKGGACSWPLSAIFTT

331 MLPAPKNLVVSRVTEDSARLSWTAPDAAFDSFTIEYSEHPIDGEAIPLFVPGSER
    SYDLTGLKPGTEYYVRIHGVKGGWFSHPLWAFFTT

332 MLPAPKNLVVSRVTEDSARLSWQGVARAFDSFLITYREQIFAGEVIVLTVPGSE
    RSYDLTGLKPGTEYGVTIAGVKGGWRSKPLNAESTT

333 MLPAPKNLVVSRVTEDSARLSWTAPDAAFDSFGIAYVESYWYGEAIVLTVPGS
    ERSYDLTGLKPGTEYNVPIYGVKGGDGSGPLSAIFTT

334 MLPAPKNLVVSRVTEDSARLSWTAPDAAFDSFYITYVELNLAGEAIVLTVPGS
    ERSYDLTGLKPGTEYPVPILGVKGGSLSQPLSAIFTT

335 MLPAPKNLVVSRVTEDSARLSWTAPDAAFDSFPISYIESIADGEAIVLTVPGSER
    SYDLTGLKPGTEYWVAIVGVKGGPFSWSLSAIVTT

336 MLPAPKNLVVSEVTEDSARLSWQGVARAFDSFLITYREQIFAGEVIVPTVPGSE
    RSYDLTGLKPGTEYPVPIAGVKGGGPSAPLSAIFTT

337 MLPAPKNLVVSRVTEDSARLSWTTPDAAFDSFPIYYWEVTITGEAIYLSVPGSE
    RSYDLTGLKPGTEYPVDIPGVKGGAASPPLSAIFTT

338 MLPAPKNLVVSRVTEDSARLSWTAPDAAFDSFPILYLEHTVRSEAIVLTVPGSE
    RSYDLTDLKPGTEYCVPIDGVKGGLRSRPLSAIFTT

339 MLPAPKNLVVSRVTEDSARLSWTAPDAAFDSFPIPYTEPPDPGEAIVLTVPGSE
    RSYDLTGLKPGTEYLVTILGVKGGSMSVPLSAIFTT

340 MLPAPKNLVVSRVTEDSARLSWTAPDAAFDSFTIDYWENRCPGEAIVLTVPGS
    ERSYDLTGLKPGTEYCVWISGVKGGYSSWPLSAIFTT

341 MLPAPKNLVVSRVTEDSARLSWQGVARAFDSFLITYREQIFAGEVIVLTVPGSE
    RSYDLTGLKPGTEYPVWIQGVKGGHLSDPLSAIVTT

342 MLPAPKNLVVSRVTEDSARLSWTAPDAAFDSFLIPYAETSPSGEAIVLTVPGSE
    RSYDLTGLKPGTEYSVLIHGVKGGDYSEPLSAIFTT

343 MLPAPKNLVVSRVTEDSARLSWTAPDAAFDSFMIVYYEYTRFGEAIVLTVPGS
    ERSYDLTGLKPGTEYTVPIDGVKGGGRSSPLSAIFTT

344 MLPAPKNLVVSRVTEDSARLSWTAPDAAFDSFFIPYAEPSPTGEAIVLTVPGSE
    RSYDLTGLKPGTEYSVLIHGVKGGHLSDPLSAIVTT

345 MLPAPKNLVVSEVTEDSARLSWQGVARAFDSFLITYREQIFAGEVIVLTVPGSE
    RSYDLTGLKPGTEYPVWIQGVKGGSPSAPLSAEFTT

346 MLPAPKNLVVSRVTEDSARLSWTAPDAAFDSFIIPYAEVRPDGEAIVLTVPGSE
    RSYDLTGLKPGTEYSVLIHGVKGGKLSLPLSAIFTT

347 MLPAPKNLVVSRVTEDSARLSWTAPDAAFDSFGIVYLEMMVTGEAIVLTVPGS
    ERSYDLTGLKPGTEYDVPILGVKGGTRSVPLSAIFTT

348 MLPAPKNLVVSRVTEDSARLSWTAPDAAFDSFLIYYEEGYLEYYYSGEAIVLT
    VPGSERSYDLTGLKPGTEYYVGIVGVKGGGLSGPLSAISTT

349 MLPAPKNLVVSRVTEDSARLSWTAPDAAFDSFPIAYAEPRPDGEAIVLTVPGSE
    RSYDLTGLKPGTEYSVLIHGVKGGDWSLPLSAIFTT

350 MSLPAPKNLVVSRVTEDSARLSWTAPDAAFDSFTIHYREFQLSGEAIVLTVPGS
    ERSYDLTGLKPGTEYDVPIEGVKGGPGSRPLSAIFTT

351 MLPAPKNLVVSEVTEDSARLSWQGVARAFDSFLITYREQIFAGEVIVLTVPGSE
    CSYDLTGLKPGTEYPVWIQGVKGGSPSAPLSAEFTT

TABLE 4-continued

CD71-binding FN3 domain sequences

SEQ ID Amino Acid sequence of FN3 domains that bind to CD71

352 MLPAPKNLVVSRVTEDSARLSWTAPDAAFDSFEIDYDELAIYGEAIVLTVPGSE
RSYDLTGLKPGTEYGVRIPGVKGGMPSLPLSAIVTT

353 MLPAPENLVVSEVTEDSARLSWQGVARAFDSFLITYREQIFAGEVIVLTVPGSE
RSYDLTGLKPGTEYPVWIQGVKGGSPSAPLSAESTT

354 MLPAPKNLVVSRVTEDSARLSWTAPDAAFDSFAIAYGEHIVIGEAIVLTVPGSE
RSYDLTGLKPGTEYMVPIAGVKGGPISLPLSAIFTT

355 MLPAPKNLVVSRVTEDSARLSWTAPDAAFDSFFIPYAEPSPTGEAIVLTVPGSE
RSYDLTGLKPGTEYSVLIHGVKGGHLSDPLSAIFTT

356 MLPAPKNLVVSRVTEDSARLSWTAPDAAFDSFSIGYVELVLLGEAIVLTVPGSE
RSYDLTGLKPGTEYDVLIPGVKGGSLSRPLSAIFTT

357 MLPAPKNLVVSRVTEDSARLSWTAPDAAFDSFAIPYAELSRNGEAIVLTVPGSE
RSYDLTGLKPGTEYTVLIHGVKGGCLSDPLSAIFTT

358 MLPAPKNLVVSRVTEDSARLSWTAPDAAFDSFHIEYLELSRHGEAIVLTVPGSE
RSYDLTGLKPGTEYWVMIFGVKGGGPSKPLSAIFTT

359 MLPAPKNLVVSRVTEDSARLSWTAPDAAFDSFVYNEVHWIGEAIVLTVPGSER
SYDLTGLKPGTEYFVGIYGVKGGHWSKPLSAIFTT

360 MLPAPKNLVVSRVTEDSARLSWTAPDAAFDSFEIDYDELAIYGEAIVLTVPGSE
RSYDLTGLKPGTEYGVRIPGVKGGMPSLPLSAIVTT

361 MLPAPKNLVVSRVTEDSARLSWTAPDAAFDSFQIVYSELWIKGEAIVLTVPGSE
RSYDLTGLKPGTEYQVPIPGVKGGRNSFPLSAIFTT

362 MLPAPKNLVVSRVTEDSARLSWTAPDAAFDSFKIRYTETRSIGEAIVLTVPGSE
RSYDLTGLKPGTEYCVPIGGVKGGDSSWPLSAISTT

363 MLPAPKNLVVSRVTEDSARLSWTAPDAAFDSFCISYYERMGRGEAIVLTVPGS
ERSYDLTGLKPGTEYMVYIFGVKGGLNSLPLSAIFTT

364 MLPAPKNLVVSRVTEDSARLSWTAPDAAFDSFYIVYAEPIPNGEAIVLTVPGSE
RSYDLTGLKPGTEYSVLIHGVKGGRNSDPLSAIFTT

365 MLPAPKNLVVSRVTKDSARLSWTAPDAAFDSFPIAYAEPRPDGEAIVLTVPGSE
RSYDLTGLKPGTEYSVLIHGVKGGLLSSPLSAIFTT

366 MLPAPKNLVVSRVTEDSARLSWTAPDAAFDSFTIDYDEPRSPGEAIVLTVPGSE
RSYDLTGLKPGTEYRVFIWGIKGGDTSFPLSAIFTT

367 MLPAPKNLVVSRVTEDSARLSWTAPDAAFDSFTILYAEQAQFGEAIVLTVPGSE
RSYDLTGLKPGTEYPITGVKGGTRSGPLSAISTT

368 MLPAPKNLVVSRVTEDSARLSWTAPDAAFDSFIIPYAEVRPDGEAIVLTVPGSE
RSYDLTGLKPGTEYSVLIHGVKGGHLSDPLSAISTT

369 MLPAPKNLVVSRVTEDSARLSWTAPDAAFDSFHIAYEETATSGEAIYLRVPGSE
RSYDLTGLKPGTEYGVEIEGVKGGARSRPLYADFTT

370 MLPAPKNLVVSRVTEDSARLSWQGVARAFDSFLITYREQIFAGEVIVLTVPGSE
RSYDLTGLKPGTEYPVWIQGVKGGDLSNPLSAIFTT

371 MLPAPKNLVVSRVTEDSARLSWTAPDAAFDSFPISYLELSLYGEAIVLTVPGSE
RSYDLTGLKPGTEYPVGIAGVKGGVVSRPLSAIFTT

372 MLPAPKNLVVSRVTEDSARLSWTAPDAAFDSFTIGYREWYWYGEAIVLTVPG
SERSYDLTGLKPGTEYNVPISGVKGGLDSFPLSAIFTT

373 MLPAPKNLVVSEVTEDSARLSWQGVARAFDSFLITYREQIFAGEVIVLTVPGSE
RSYDLTGLKPGTEYPVWIQGVKGGSPSAPLSAESTT

374 MLPAPKNLVVSRVTEDSARLSWTAPDAAFDSFSITYLEWWNLGEAIVLTVPGS
ERSYDLTGLKPGTEYMVTIPGVKGGMSSYPLSAIFTT

375 MLPAPKNLVVSRVTEDSARLSWTAPDAAFDSFTISYGEEALIGEAIYLRVPGSE
RSYDLTGLKPGTEYYVHIEGVKGGSWSQPLAAAFTT

376 MLPAPKNLVVSRVTEDSARLSWTAPDAAFDSFTIEYYENIGIGEAIVLTVPGSE
RSYDLTGLKPGTEYSVPIVGVKGGPYSHPLSAIFTT

TABLE 4-continued

CD71-binding FN3 domain sequences

SEQ ID | Amino Acid sequence of FN3 domains that bind to CD71

377 MLPAPKNLVVSRVTEDSARLSWTAPDAAFDSFPIAYAEPRPDGEAIVLTVPGSE
RSYDLTGLKPGTEYSVLIHGVKGGLLSSPLSAIFTT

378 MLPAPKNLVVSRVTEDSARLSWTAPDAAFDSFGIGYYEHKRFGEAIQLSVPGS
ERSYDLTGLKPGTEYEVDIEGVKGGVLSWPLFAEFTT

379 MLPAPKNLVVSRVTEDSARLSWTAPDAAFDSFVIEYTERFWSGEAIVLTVPGSE
RSYDLTGLKPGTEYSVPIDGVKGGQCSTPLSAIFTT

380 MLPAPKNLVVSRVTEDSARLSWTAPDAAFDSFWIDYEEEGVIGEAIYLHVPGS
ERSYDLTGLKPGTEYVVKIHGVKGGHPSHPLVAVFTT

381 MLPAPKNLVVSRVTEDSARLSWQGVARAFDSFLITYVELRHLGEAIVLTVPGS
ERSYDLTGLKPGTEYPVWIQGVKGGSPSAPLSAEFTT

382 MLPAPKNLVVSRVTEDSARLSWTAPDAAFDSFLIPYAETSPSGEAIVLTVPGSE
RSYDLTGLKPGTEYSVLIHGVKGGDYSSPLSAIFTT

383 MLPAPKNLVVSRVTEDSARLSWTAPDAAFDSFPIAYAEPRPDGEAIVLTVPGSE
RSYDLTGLKPGTEYSVLIHGVKGGLLSSPLSAISTT

384 MLPAPKNLVVSRVTEDSARLSWQGVARAFDSFSILYLELTPKGEAIVLTVPGSE
RSYDLTGLKPGTEYPVWIQGVKGGSPSAPLSAEFTT

385 MLPAPKNLVVSRVTEDSARLSWTAPDAAFDSFIIEYFEPIPIGEAIVLTVPGSERS
YDLTGLKPGTEYAVNIYGVKGGYLSHPLSAIFTT

386 MLPAPKNLVVSEVTEDSARLSWQGVARAFDSFLITYREQIFAGEVIVLTVPGSE
CSYDLTGLKPGTEYPVWIQGVKGGSPSAPLSAEFTT

387 MLPAPKNLVVSRVTEDSARLSWTAPDAAFDSFAIEYTEFLYSGEAIVLTVPGSE
RSYDLTGLKPGTEYGVPINGVKGGFVSPPLSAIVTT

388 MLPAPKNLVVSRVTEDSARLSWTAPDAAFDSFPIKYREVLRCGEAIVLTVPGSE
RSYDLTGLKPGTEYTVPITGVKGGFGSSPLSAIFTT

389 MLPAPENLVVSRVTEDSARLSWTAPDAAFDSFWIEYYEGVIQGEAIVLTVPGSE
RSYDLTGLKPGTEYFVAIWGVKGGKWSVPLSAIFTT

390 MLPAPKNLVVSRVTEDSARLSWQGVARAFDSFLITYREQIFAGEVIVLTVPGSE
RSYDLTGLKPGTEYPVWIQGVKGGSPSAEFTT

391 MLPAPKNLVVSRVTEDSARLSWTAPDAAFDSFQIHYWETQGFGEAIVLTVPGS
ERSYDLTGLKPGTEYPVLIPGVKGGPSSLPLSAIFTT

392 MLPAPKNLVVSRVTEDSARLSWTAPDAAFDSFFIPYAEPSPTGEAIVLTVPGSE
RSYDLTGLKPGTEYSVLIHGVKGGHLSDPLSAIFTT

393 MLPAPKNLVVSRVTEDSARLSWTAPDAAFDSFAIEYYEPVPAGEAIYLDVPGS
ERSYDLTGLKPGTEYDVTIYGVKGGYYSHPLFASFTT

394 MLPAPKNLVVSEVTEDSARLSWQGVARAFDSFLITYREQIFAGEVIVLTVPGSE
RSYDLTGLKPGTEYPVWIQGVKGGSPSAPLSAIFTT

395 MLPAPKNLVVSEVTEDSARLSWQGVARAFDSFLITYREQIFAGEVIVLTVPGSE
RSYDLTGLKPGTEYPVWIQGVKGGSPSAPLSAEFTT

396 MSLPAPKNLVVSRVTEDSARLSWTAPDAAFDSFPIAYLEVFYEGEAIVLTVPGS
ERSYDLTGLKPGTEYQVPIEGVKGGAMSLPLSAIFTT

397 MLPAPKNLVVSRVTEDSARLSWTAPDAAFDSFHIWYEEETTIGEAIYLHVPGSE
RSYDLTGLKPGTEYEVHITGVKGGPYSRPLFANFTT

398 MLPAPKNLVVSRVTEDSARLSWTAPDAAFDSFGIAYDEWPEFGEAIVLTVPGS
ERSYDLTGLKPDTEYIVEIYGVKGGWFSWPLSAIFTT

399 MLPAPKNLVVSRVTEDSARLSWTAPDAAFDSFFIPYAEPSPTGEAIVLTVPGSE
RSYDLTGLKPGTEYSVLIHGVKGGHLSDPLSVIFTT

400 MLPAPKNLVVSRVTEDSARLSWTAPDAAFDSFYIWYEEVMYLGEAIVLTVPGS
ERSYDLTGLKPGTEYNVPIPGVKGGHSSPPLSAIFTT

401 MLPAPKNLVVSRVTEDSARLSWTAPDAAFDSFHILYEELFLVGEAIVLTVPGSE
RSYDLTGLKPGTEYKVPISGVKGGPVSRPLSAIFTT

TABLE 4-continued

CD71-binding FN3 domain sequences

SEQ ID Amino Acid sequence of FN3 domains that bind to CD71

402 MLPAPKNLVVSRVTEDSARLSWQGVARAFDSFLITYREQIFAGEVIVLTVPGSE
RSYDLTGLKPGTEYPVWIQGVKGGSPSAPLSAEFTT

403 MLPAPKNLVVSRVTEDSARLSWTAPDAAFDSFHIVYHEPRPSGEAIWLHVPGS
ERSYDLTGLKPGTEYEVGIVSVKGGDLSVPLVAFFTT

404 MLPAPKNLVVSRVTEDSARLSWTAPDAAFDSFYIAYAEPRPDGEAISLLVPGSE
RSYDLTGLKPGTEYSVLIHGVKGGLLSSPLYAVFTT

405 MLPAPKNLVVSRVTEDSARLSWTAPDAAFDSFYIAYAEPRPDGEAIFLVVPGSE
RSYDLTGLKPGTEYSVLIHGVKGGLLSSPLHANFTT

406 MLPAPKNLVVSRVTEDSARLSWTAPDAAFDSFYIAYAEPRPDGEAILLDVPGSE
RSYDLTGLKPGTEYSVLIHGVKGGLLSSPLYASFTT

407 MSLPAPKNLVVSRVTEDSARLSWTAPDAAFDSFYIAYAEPRPDGEAISLYVPGS
ERSYDLTGLKPGTEYSVLIHGVKGGLLSSPLSAISTT

408 MLPAPKNLVVSRVTEDSARLSWTAPDAAFDSFFIGYLEPQPPGEAIQLRVPGSE
RSYDLTGLKPGTEYNVTIQGVKGGFPSMPLSAIFTT

409 MLPAPKNLVVSRVTEDSARLSWTAPDAAFDSFHISYEEDYTFGEAIYLRVPGSE
RSYDLTGLKPGTEYRVVIGGVKGGWFSEPLLAAFTT

410 MLPAPKNLVVSRVTEDSARLSWTAPDAAFDSFFIGYLEPQPPGEAIYLTVPGSE
RSYDLTGLKPGTEYNVTIQGVKGGFPSYPLDASFTT

411 MLPAPKNLVVSRVTEDSARLSWTAPDAAFDSFFIGYLEPQPPGEAIDLGVPGSE
RSYDLTGLKPGTEYNVTIQGVKGGFPSMPLDPLEAYFTT

412 MLPAPKNLVVSRVTEDSARLSWTAPDAAFDSFYIAYAEPRPDGEAILLLVPGSE
RSYDLTGLKPGTEYSVLIHGVKGGLLSSPLSAIFTT

413 MLPAPKNLVVSRVTEDSARLSWTAPDAAFDSFYIAYAEPRPDGEAINLQVPGS
ERSYDLTGLKPGTEYSVLIHGVKGGLLSSPLVAFFTT

414 MLPAPKNLVVSRVTEDSARLSWTTPDAAFDSFFIGYLEPQPPGEAISLQVPGSE
RSYDLTGLKPGTEYNVTIQGVKGGFPSSPLFAVFTT

415 MLPAPKNLVVSRVTEDSARLSWTAPDAAFDSFYIAYAEPRPDGEAIELHVPGSE
RSYDLTGLKPGTEYSVLIHGVKGGLLSSPLFTT

416 MLPAPKNLVVSRVTEDSARLSWTAPDAAFDSFYIAYAEPRPDGEAIQLVVPGS
ERSYDLTGLKPGTEYSVLIHGVKGGLLSSPLSAIFTT

417 MLPAPKNLVVSRVTEDSARLSWTAPDAAFDSFYIAYAEPRPDGEAITLDVPGSE
RSYDLTGLKPGTEYSVLIHGVKGGLLSSPLSAIFTT

418 MLPAPKNLVVSRVTEDSARLSWTAPDAAFDSFYIAYAEPRPDGEAIWLVVPGS
ERSYDLTGLKPGTEYSVLIHGVKGGLLSSPLVASFTT

419 MLPAPKNLVVSRVTEDSARLSWTAPDAAFDSFYIAYAEPRPDGEAINLDVPGS
ERSYDLTGLKPGTEYSVLIHGVKGGLLSSPLVAEFTT

420 MLPAPKNLVVSRVTEDSARLSWTAPDAAFDSFYIAYAEPRPDGEAIHLSVPGSE
RSYDLTGLKPGTEYSVLIHGVKGGLLSSPLVAIFTT

421 MLPAPKNLVVSRVTEDSARLSWTAPDAAFDSFFIGYLEPQPPGEAIALWVPGSE
RSYDLTGLKPGTEYNVTIQGVKGGFPSMPLSAIFTT

422 MLPAPKNLVVSRVTEDSARLSWTAPDAAFDSFYIAYAEPRPDGEAIILVVPGSE
RSYDLTGLKPGTEYSVLIHGVKGGLLSSPLSAHFTT

423 MLPAPKNLVVSRVTEDSARLSWTAPDAAFDSFFIGYLEPQPPGEAIQLWVPGSE
RSYDLTGLKPGTEYNVTIQGVKGGFPSHPLGAVFTT

424 MLPAPKNLVVSRVTEDSARLSWTAPDAAFDSFYIAYAEPRPDGEAIQLHVPGS
ERSYDLTGLKPGTEYSVLIHGVKGGLLSSPLLASFTT

425 MLPAPKNLVVSRVTEDSARLSWTAPDAAFDSFYIAYAEPRPDGEAIALHVPGS
ERSYDLTGLKPGTEYSVLIHGVKGGLLSSPLVAFFTT

426 MLPAPKNLVVSRVTEDSARLSWTAPDAAFDSFFIGYLEPQPPGEAIHLHVPGSE
RSYDLTGLKPGTEYNVTIQGVKGGFPSIPLHANFTT

TABLE 4-continued

CD71-binding FN3 domain sequences

| SEQ ID | Amino Acid sequence of FN3 domains that bind to CD71 |
|---|---|
| 427 | MLPAPKNLVVSRVTEDSARLSWTAPDAAFDSFYIAYAEPRPDGEAIFLGVPGSE<br>RSYDLTGLKPGTEYSVLIHGVKGGLLSSPLSAIFTT |
| 428 | MLPAPKNLVVSRVTEDSARLSWTAPDAAFDSFYIAYAEPRPDGEAIVLRVPGS<br>ERSYDLTGLKPGTEYSVLIHGVKGGLLSSPLIASFTT |
| 429 | MLPAPKNLVVSRVTEDSARLSWTAPDAAFDSFYIAYAEPRPDGEAINLWVPGS<br>ERSYDLTGLKPGTEYSVLIHGVKGGLLSSPLDASFTT |
| 430 | MLPAPKNLVVSRVTEDSARLSWTAPDAAFDSFVIEYFEWTLNGEAIVLTVPGS<br>ERSYDLTGLKPGTEYSVQIYGVKGGCLSRPLSAIFTT |
| 431 | MLPAPKNLVVSRVTEDSARLSWTAPDAAFDSFYIAYAEPRPDGEAIHLWVPGS<br>ERSYDLTGLKPGTEYSVLIHGVKGGLLSSPLIAHFTT |
| 432 | MLPAPKNLVVSRVTEDSARLSWTAPDAAFDSFFIPYAEPSPTGEAIVLTVPGSE<br>RSYDLTGLKPGTEYSVLIHGVKGGLLSSPLSAHFTT |
| 433 | MLPAPKNLVVSRVTEDSARLSWTAPDAAFDSFYIAYAEPRPDGEAIYLYVPGS<br>ERSYDLTGLKPGTEYSVLIHGVKGGLLSSPLDAFFTT |
| 434 | MLPAPKNLVVSRVTEDSARLSWTAPDAAFDSFYIAYAEPRPDGEAIGLQVPGS<br>ERSYDLTGLKPGTEYSVLIHGVKGGLLSSPLSAIFTT |
| 435 | MLPAPKNLVVSRVTEDSARLSWTAPDAAFDSFYIAYAEPRPDGEAIQLAVPGS<br>ERSYDLTGLKPGTEYSVLIHGVKGGLLSSPLHAFFTT |
| 436 | MLPAPKNLVVSRVTEDSARLSWTAPDAAFDSFFIGYLEPQPPGEAIWLHVPGSE<br>RSYDLTGLKPGTEYNVTIQGVKGGFPSIPLIAIFTT |
| 437 | MLPAPKNLVVSRVTEDSARLSWTAPDAAFDSFYIAYAEPRPDGEAIVLDVPGS<br>ERSYDLTGLKPGTEYSVLIHGVKGGLLSSPLVAEFTT |
| 438 | MLPTPKNLVVSRVTEDSARLSWTAPDAAFDSFYIAYAEPRPDGEAIQLRVPGSE<br>RSYDLTGLKPGTEYSVLIHGVKGGLLSSPLHASFTT |
| 439 | MLPAPKNLVVSRVTEDSARLSWTAPDAAFDSFFIGYLEPQPPGEAIQLGVPGSE<br>RSYDLTGLKPGTEYNVTIQGVKGGFPSHPLNANFTT |
| 440 | MLPAPKNLVVSRVTEDSARLSWTAPDAAFDSFFIGYLEPQPPGEAIQLEVPGSE<br>RSYDLTGLKPGTEYNVTIQGVKGGFPSMPLSAIFTT |
| 441 | MLPAPKNLVVSRVTEDSARLSWTAPDAAFDSFYIAYAEPRPDGEAIFLGVPGSE<br>RSYDLTGLKPGTEYSVLIHGVKGGLLSSPLIAFFTT |
| 442 | MLPAPKNLVVSRVTEDSARLSWTAPDAAFDSFFIGYLEPQPPGEAIGLQVPGSE<br>RSYDLTGLKPGTEYNVTIQGVKGGFPSHPLKAQFTT |
| 443 | MLPAPKNLVVSRVTEDSARLSWTAPDAAFDSFYIAYAEPRPDGEAILLFVPGSE<br>RSYDLTGLKPGTEYSVLIHGVKGGLLSSPLVAHFTT |
| 444 | MLPAPKNLVVSRVTEDSARLSWTAPDAAFDSFYIAYAEPRPDGEAIGLYVPGS<br>ERSYDLTGLKPGTEYSVLIHGVKGGLLSSPLGAFFTT |
| 445 | MLPAPKNLVVSRVTEDSARLSWTAPDAAFDSFYIAYAEPRPDGEAILLQVPGS<br>ERSYDLTGLKPGTEYSVLIHGVKGGLLSSPLTAIFTT |
| 446 | MLPAPKNLVVSRVTEDSARLSWTAPDAAFDSFYIAYAEPRPDGEAITLHVPGS<br>ERSYDLTGLKPGTEYSVLIHGVKGGLLSSPLSAIFTT |
| 447 | MLPAPKNLVVSRVTEDSARLSWTAPDAAFDSFYIAYAEPRPDGEAIVLEVPGSE<br>RSYDLTGLKPGTEYSVLIHGVKGGLLSSPLDAHFTT |
| 448 | MLPAPKNLVVSRVTEDSARLSWTAPDAAFDSFYIAYAEPRPDGEAIALHVPGS<br>ERSYDLTGLKPGTEYSVLIHGVKGGLLSSPLRAVFTT |
| 449 | MLPAPKNLVVSRVTEDSARLSWTAPDAAFDSFYIAYAEPRPDGEAIQLWVPGS<br>ERSYDLTGLKPGTEYSVLIHGVKGGLLSSPLSAIFTT |
| 450 | MLPAPKNLVVSRVTEDSARLSRTAPDAAFDSFYIAYAEPRPDGEAIVLIVPGSE<br>RSYDLTGLKPGTEYSVLIHGVKGGLLSSPLSAIFTT |
| 451 | MLPAPKNLVVSRVTEDSARLSWTAPDAAFDSFFIGYLEPQPPGEAIQLWVPGSE<br>RSYDLTGLKPGTEYNVTIQGVKGGFPSRPLQAHFTT |

TABLE 4-continued

CD71-binding FN3 domain sequences

| SEQ ID | Amino Acid sequence of FN3 domains that bind to CD71 |
|---|---|
| 452 | MLPAPKNLVVSRVTEDSARLSWTAPDAAFDSFYIAYAEPRPDGEAITLDVPGSERSYDLTGLKPGTEYSVLIHGVKGGLLSSPLYAFFTT |
| 453 | MLPAPKNLVVSRVTEDSARLSWTAPDAAFDSFYIAYAEPRPDGEAIALHVPGSERSYDLTGLKPGTEYSVLIHGVKGGLLSSPLSAIFTT |
| 454 | MLPAPKNLVVSRVTEDSARLSWTAPDAAFDSFYIAYAEPRPDGEAIGLWVPGSERSYDLTGLKPGTEYSVLIHGVKGGLLSSPLIAHFTT |
| 455 | MLPAPKNLVVSRVTEDSARLSWTAPDAAFDSFYIAYAEPRPDGEAIWLVVPGSERSYDLTGLKPGTEYSVLIHGVKGGLLSSPLHARFTT |
| 456 | MLPAPKNLVVSRVTEDSARLSWTAPDAAFDSFYIAYAEPRPDGEAIFLQVPGSERSYDLTGLKPGTEYSVLIHGVKGGLLSSPLAAVFTT |
| 457 | MLPAPKNLVVSRVTEDSARLSWTAPDAAFDSFYIAYAEPRPDGEAILLHVPGSERSYDLTGLKPGTEYSVLIHGVKGGLLSSPLSAISTT |
| 458 | MLPAPKNLVVSRVTEDSARLSWTAPDAAFDSFYIAYAEPRPDGEAIILQVPGSERSYDLTGLKPGTEYSVLIHGVKGGLLSSPLSAVFTT |
| 459 | MLPAPKNLVVSRVTEDSARLSWTAPDAAFDSFYIAYAEPRPDGEAIYLKVPGSERSYDLTGLKPGTEYSVLIHGVKGGLLSSPLVAHFTT |
| 460 | MLPAPKNLVVSRVTEDSARLSWTAPDAAFDSFYIAYAEPRPDGEAIVLTVPGSERSYDLTGLKPGTEYSVLIHGVKGGLLSSPLLAYFTT |
| 461 | MLPAPKNLVVSRVTEDSARLSWTAPDAAFDSFYIAYAEPRPDGEAIILHVPGSERSYDLTGLKPGTEYSVLIHGVKGGLLSSPLEAKFTT |
| 462 | MLPAPKNLVVSRVTEDSARLSWTAPDAAFDSFYIAYAEPRPDGEAIKLEVPGSERSYDLTGLKPGTEYSVLIHGVKGGLLSSPLAIFTT |
| 463 | MLPAPKNLVVSRVTEDSARLSWTAPDAAFDSFFIGYLEPQPPGEAIYLEVPGSERSYDLTGLKPGTEYNVTIQGVKGGFPSFPLKAAFTT |
| 464 | MLPAPKNLVVSRVTEDSARLSWTAPDAAFDSFYIAYAEPRPDGEAIILRVPGSERSYDLTGLKPGTEYSVLIHGVKGGLLSSPLVAIFTT |
| 465 | MLPAPKNLVVSRVTEDSARLSWTAPDAAFDSFYIAYAEPRPDGEAIVLQVPGSERSYDLTGLKPGTEYSVLIHGVKGGLLSSPLAAWFTT |
| 466 | MLPAPKNLVVSRVTEDSARLSWTAPDAAFDSFYIAYAEPRPDGEAIFLQVPGSERSYDLTGLKPGTEYSVLIHGVKGGLLSSPLNAFFTT |
| 467 | MLPAPKNLVVSRVTEDSARLSWTAPDAAFDSFFIGYLEPQPPGEAIILGVPGSERSYDLTGLKPGTEYSVLIHGVKGGLLSSPLHAYSTT |
| 468 | MLPAPKNLVVSRVTEDSARLSWTAPDAAFDSFYIAYAEPRPDGEAILLDVPGSERSYDLTGLKPGTEYSVLIHGVKGGLLSSPLSAIFTT |
| 469 | MLPAPKNLVVSRVTEDSARLSWTAPDAAFDSFYIAYAEPRPDGEAILLLVPGSERSYDLTGLKPGTEYSVLIHGVKGGLLSSPLSAVFTT |
| 470 | MLPAPKNLVVSRVTEDSARLSWTAPDAAFDSFYIAYAEPRPDGEAIHLLVPGSERSYDLTGLKPGTEYSVLIHGVKGGLLSSPLLAHFTT |
| 471 | MLPAPKNLVVSRVTEDSARLSWTAPDAAFDSFYIAYAEPRPDGEAIQLWVPGSERSYDLTGLKPGTEYSVLIHGVKGGLLSSPLDAYFTT |
| 472 | MLPAPKNLVVSRVTEDSARLSWTAPDAAFDSFFIGYLEPQPPGEAIVLTVPGSERSYDLTGLKPGTEYNVTIQGVKGGFPSMPLASFTT |
| 473 | MLPAPKNLVVSRVTEDSARLSWTAPDAAFDSFHIVYHEPRPSGEAIHLQVPGSERSYDLTGLKPGTEYNVTIQGVKGGFPSYPLSAFFTT |
| 474 | MLPAPKNLVVSRVTEDSARLSWTAPDAAFDSFFIGYLEPQPPGEAIQLWVPGSERSYDLTGLKPGTEYNVTIQGVKGGFPSMPLSAIFTT |
| 475 | MLPAPKNLVVSRVTEDSARLSWTAPDAAFDSFRISYCETFYHGEAIVLTVPGSERSYDLTGLKPGTEYSVLIHGVKGGLLSSPLIAKFTT |
| 476 | MLPAPKNLVVSRVTEDSARLSWTAPDAAFDSFYIAYAEPRPDGEAIWLKVPGSERSYDLTGLKPGTEYSVLIHGVKGGLLSSP TABLE 4-continued CD71-binding FN3 domain sequences SEQ
ID  Amino Acid sequence of FN3 domains that bind to CD71

477 MLPAPKNLVVSRVTEDSARLSWTAPDAAFDSFYIAYAEPRPDGEAIWLKVPGS
    ERSYDLTGLKPGTEYSVLIHGVKGGLLSSPLQANFTT

478 MLPAPKNLVVSRVTEDSARLSWTAPDAAFDSFYIAYAEPRPDGEAIQLQVPGS
    ERSYDLTGLKPGTEYSVLIHGVKGGLLSSPLSAIVTT

479 MLPAPKNLVVSRVTEDSARLSWTAPDAAFDSFPIAYAEPRPDGEAIVLTVPGSE
    RSYDLTGLKPGTEYSVLIHGVKGGLLSSPLSAFFTT

480 MLPAPKNLVVSRVTEDSARLSWTAPDAAFDSFYIAYAEPRPDGEAIALLVPGSE
    RSYDLTGLKPGTEYSVLIHGVKGGLLSSPLVAQFTT

481 MLPAPKNLVVSRVTEDSARLSWTAPDAAFDSFYIAYAEPRPDGEAIILHVPGSE
    RSYDLTGLKPGTEYSVLIHGVKGGLLSSPLEAKFTT

482 MLPAPKNLVVSRVTEDSARLSWTAPDAAFDSFYIAYAEPRPDGEAIDLHVPGS
    ERSYDLTGLKPGTEYSVLIHGVKGGLLSSPLHALFTT

483 MLPAPKNLVVSRVTEDSARLSWTAPDAAFDSFYIAYAEPRPDGEAILLDVPGSE
    RSYDLTGLKPGTEYSVLIHGVKGGFPSMPLSAIFTT

484 MLPAPKNLVVSRVTEDSARLSWTAPDAAFDSFFIGYLEPQPPGEAIDLAVPGSE
    RSYDLTGLKPGTEYSVLIHGVKGGLLSSPLSFTT

485 MLPAPKNLVVSRVTEDSARLSWTAPDAAFDSFYIAYAEPRPDGEAIYLGVPGS
    ERSYDLTGLKPGTEYSVLIHGVKGGLLSSPLRAKFTT

486 MLPAPKNLVVSRVTEDSARLSWTAPDAAFDSFYIAYAEPRPDGEAIQLGVPGS
    ERSYDLTGLKPGTEYSVLIHGVKGGLLSSPLSAIFTT

487 MLPAPKNLVVSRVTEDSARLSWTAPDAAFDSFFIGYLEPQPPGEAISLLVPDSE
    RSYDLTGLKPGTEYNVTIQGVKGGFPSMPLKFTT

488 MLPAPKNLVVSRVTEDSARLSWTAPDAAFDSFYIAYAEPRPDGEAIGLGVPGS
    ERSYDLTGLKPGTEYSVLIHGVKGGLLSSPLDASFTT

489 MLPAPKNLVVSRVTEDSARLSWTAPDAAFDSFYIAYAEPRPDGEAIQLTVPGSE
    RSYDLTGPKPGTEYWVLIQGVKGGGSSVPLVAYFTT

490 MLPAPKNLVVSRVTEDSARLSWTAPDAAFDSFYIAYAEPRPDGEAISLDVPGSE
    RSYDLTGLKPGTEYSVLIHGVKGGLLSSPLEASFTT

491 MLPAPKNLVVSRVTEDSARLSWTAPDAAFDSFFIGYLEPQPPGEAIILAVPGSER
    SYDLTGLKPGTEYNVTIQGVKGGFPSLPLVASFTT

492 MLPAPKNLVVSRVTEDSARLSWTAPDAAFDSFDIGYTEYGGYGEAIYLSVPGS
    ERSYDLTGLKPGTEYWVLIQGVKGGGSSVPLSAIFTT

493 MLPAPKNLVVSRVTEDSARLSWTAPDAAFDSFYIAYAEPRPDGEAISLSVPGSE
    RSYDLTGLKPGTEYSVLIHGVKGGLLSSPLIANFTT

494 MLPAPKNLVVSRVTEDSARLSWTAPDAAFDSFYIAYAEPRPDGEAIALLVPGSE
    RSYDLTGLKPGTEYSVLIHGVKGGLLSSPLSAIVTT

495 MLPAPKNLVVSRVTEDSARLSWTAPDAAFDSFYIAYAEPRPDGEAIILDVPGSE
    RSYDLTGLKPGTEYSVLIHGVKGGLLSSPLSSIFTT

496 MLPAPKNLVVSRVTEDSARLSWTAPDAAFDSFYIAYAEPRPDGEAIVLWVPGS
    ERSYDLTGLKPGTEYSVLIHGVKGGLLSSPLRASFTT

497 MLPAPKNLVVSRVTEDSARLSWTAPDAAFDSFYIAYAEPRPDGEAIKLDVPGS
    ERSYDLTGLKPGTEYSVLIHGVKGGLLSSPLVAFFTT

498 MLPAPKNLVVSRVTEDSARLSWTAPDAAFDSFYIAYAEPRPDGEAIILEVPGSE
    RSYDLTGLKPGTEYSVLIHGVKGGLLSSPLVAYFTT

499 MLPAPKNLVVSRVTEDSARLSWTAPDAAFDSFYIAYAEPRPDGEAIHLWVPGS
    ERSYDLTGLKPGTEYSVLIHGVKGGLLSSPLHADFTT

500 MLPAPKNLVVSRVTEDSARLSWTAPDAAFDSFYIAYAEPRPDGEAIWLEVPGS
    ERSYDLTGLKPGTEYSVLIHGVKGGLLSSPLVADFTT

501 MLPAPKNLVVSRVTEDSARLSWTAPDAAFDSFYIAYAEPRPDGEAISLWVPGS
    ERSYDLTGLKPGTEYSVLIHGVKGGLLSSPLLAHFTT

TABLE 4-continued

CD71-binding FN3 domain sequences

SEQ ID  Amino Acid sequence of FN3 domains that bind to CD71

502 MLPAPKNLVVSRVTEDSARLSWTAPDAAFDSFDIGYTEYGGYGEAILHVPGSE
    RSYDLTGLKPGTEYWVLIQGVKGGGSSVPLSAIFTT

503 MLPAPKNLVVSRVTEDSARLSWTAPDAAFDSFFIGYLEPQPPGEAIVLLVPGSE
    RSYDLTGLKPGTEYNVTIQGVKGGFPSVPLAAFFTT

504 MLPAPKNLVVSRVTEDSARLSWTAPDAAFDSFFIGYLEPQPPGEAILLWVPGSE
    RSYDLTGLKPGTEYNVTIQGVKGGFPSQFTT

505 MLPAPKNLVVSRVTEDSARLSWTAPDAAFDSFFIGYLEPQPPGEAILLGVPGSE
    RSYDLTGLKPGTEYNVTIQGVKGGFPSMPLHPLVALFTT

506 MLPAPKNLVVSRVTEDSARLSWTAPDAAFDSFYIAYAEPRPDGEAIGLDVPGS
    ERSYDLTGLKPGTEYSVLIHGVKGGLLSSPLSAIFTT

507 MLPAPKNLVVSRVTEDSARLSWTAPDAAFDSFYIAYAEPRPDGEAIHLSVPGSE
    RSYDLTGLKPGTEYSVLIHGVKGGLLSSPLAAYFTT

508 MLPAPKNLVVSRVTEDSARLSWTAPDAAFDSFFIGYLEPQPPGEAIVLAVPGSE
    RSYDLTGLKPGTEYNVTIQGVKGGFPSYPLVAAFTT

509 MLPAPKNLVVSRVTEDSARLSWTAPDAAFDSFYIAYAEPRPDGEAILLQVPGSCRSYDLTGLKP
    GTEYSVLIHGVKGGLLSSPLTAIFTT

510 MLPAPKNLVVSRVTEDSARLSWTAPDAAFDSFFIGYLEPQPPGEAINLQVPGSE
    RSYDLTGLKPGTEYNVTIQGVKGGFPSFPLSAVFTT

511 MLPAPKNLVVSRVTEDSARLSWTAPDAAFDSFYIAYAEPRPDGEAIQLHVPGS
    ERSYDLTGLKPGTEYSVLIHGVKGGLLSSPLVAIFTT

512 MLPAPKNLVVSRVTEDSARLSWTAPDAAFDSFYIAYAEPRPDGEAIWLAVPGS
    ERSYDLTGLKPGTEYSVLIHGVKGGLLSSPLHAQFTT

513 MLPAPKNLVVSRVTEDSARLSWTAPDAAFDSFYIAYAEPRPDGEAILLGVPGSE
    RSYDLTGLKPGTEYSVLIHGVKGGLLSSPLFTT

514 MLPAPKNLVVSRVTEDSARLSWTAPDAAFDSFYIAYAEPRPDGEAIGLQVPGS
    ERSYDLTGLKPGTEYSVLIHGVKGGLLSSPLCAEFTT

515 MLPAPKNLVVSRVTEDSARLSWTAPDAAFDSFYIAYAEPRPDGEAIVLWVPGS
    ERSYDLTGLKPGTEYSVLIHGVKGGLLSSPLIAEFTT

516 MLPAPKNLVVSRVTEDSARLSWTAPDAAFDSFYIAYAEPRPDGEAISLSVPGSE
    RSYDLTGLKPGTEYSVLIHGVKGGLLSSPPKFTT

517 MLPAPKNLVVSRVTEDSARLSWTAPDAAFDSFYIAYAEPRPDGEAIILEVPGSE
    RSYDLTGLKPGTEYSVLIHGVKGGLLSSPLRAVFTT

518 MLPAPKNLVVSRVTEDSARLSWTAPDAAFDSFYIAYAEPRPDGEAIHLVVPGS
    ERSYDLTGLKPGTEYSVLIHGVKGGLLSSPLSAIFTT

519 MLPAPKNLVVSRVTEDSARLSWTAPDAAFDSFYIAYAEPRPDGEAISLKVPGSE
    RSYDLTGLKPGTEYSVLIHGVKGGLLSSPLEAIFTT

520 MLPAPKNPVVSRVTEDSARLSWTAPDAAFDSFYIAYAEPRPDGEAIHLLVPGSE
    RSYDLTGLKPGTEYSVLIHGVKGGLLSSPLKRLSPPVVTITITMAVCRKPVAEN
    LSQTLS

521 MLPAPKNLVVSRVTEDSARLSWTAPDAAFDSFFIGYLEPQPPGEAIFLDVPGSE
    RSYDLTGLKPGTEYNVTIQGVKGGFPSPLTAFFTT

522 MLPAPKNLVVSRVTEDSARLSWTAPDAAFDSFFIGYLEPQPPGEAIVLDVPGSE
    RSYDLTGLKPGTEYNVTIQGVKGGFPSHPLAAAFTT

523 MLPAPKNLVVSRVTEDSARLSWTAPDAAFDSFFIGYLEPQPPGEAIGLAVPGSE
    RSYDLTGLKPGTEYNVTIQGVKGGFPSVPLQANFTT

524 MLPAPKNLVVSRVTEDSARLSWTAPDAAFDSFYIAYAEPRPDGEAILLRVPGSE
    RSYDLTGLKPGTEYSVLIHGVKGGLLSSPLVAEFTT

525 MLPAPKNLVVSRVTEDSARLSWTAPDAAFDSFYIAYAEPRPDGEAILLQVPGSE
    RSYDLTGLKPGTEYSVLIHGVKGGLLSSPLSASFTT

526 MLPAPKNLVVSRVTEDSARLSWTAPDAAFDSFYIAYAEPRPDGEAIGLHVPGS
    ERSYDLTGLKPGTEYSVLIHGVKGGLLSSPLTASFTT

TABLE 4-continued

CD71-binding FN3 domain sequences

SEQ ID Amino Acid sequence of FN3 domains that bind to CD71

527 MLPAPKNLVVSRVTEDSARLSWTAPDAAFDSFYIAYAEPRPDGEAIGLRVPGS
ERSYDLTGLKPGTEYSVLIHGVKGGLLSSPLSAIFTT

528 MLPAPKNLVVSRVTEDSARLSWTAPDAAFDSFYIAYAEPRPDGEAIVLRVPGS
ERSYDLTGLKPGTEYSVLIHGVKGGLLSSPLAASFTT

529 MLPAPKNLVVSRVTEDSARLSWTAPDAAFDSFYIAYAEPRPDGEAIQLLVPGSE
RSYDLTGLKPGTEYSVLIHGVKGGLLSSPLVAHFTT

530 MLPAPKNLVVSRVTEDSARLSWTAPDAAFDSFYIAYAEPRPDGEAIWLLVPGS
ERSYDLTGLKPGTEYSVLIHGVKGGLLSSPLVAFFTT

531 MLPAPKNLVVSRVTEDSARLSWTAPDAAFDSFFIGYLEPQPPGEAIHLYVPGSE
RSYDLTGLKPGTEYNVTIQGVKGGFPSDPLDAVFTT

532 MLPAPKNLVVSRVTEDSARLSWTAPDAAFDSFFIGYLEPQPPGEAIYLDVPGSE
RSYDLTGLKPGTEYNVTIQGVKGGFPSTFTT

533 MLPAPKNLVVSRVTEDSARLSWTAPDAAFDSFYIAYAEPRPDGEAIQLFVPGSE
RSYDLTGLKPGTEYSVLIHGVKGGLLSSPLKAYFTT

534 MLPAPKNLVVSRVTEDSARLSWTAPDAAFDSFYIAYAEPRPDGEAIVLVVPGS
ERSYDLTGLKPGTEYSVLIHGVKGGLLSSPLSAIFTT

535 MLPAPKNLVVSRVTEDSARLSWTAPDAAFDSFFIGYLEPQPPGEAIQLTVPGSE
RSYDLTGLKPGTEYNVTIQGVKGGFPSLPLSADFTT

536 MLPAPKNLVVSRVTEDSARLSWTAPDAAFDSFYIAYAEPRPDGEAILLQVPGSE
RSYDLTGLKPGTEYSVLIHGVKGGLLSSPLDAEFTT

537 MLPAPKNLVVSRVTEDSARLSWTAPDAAFDSFYIAYAEPRPDGEAIVLAVPGS
ERSYDLTGLKPGTEYSVLIHGVKGGLLSSPLYASFTT

538 MLPAPKNLVVSRVTEDSARLSWTTPDAAFDSFYIAYAEPRPDGEAIRLQVPGSE
RSYDLTGLKPGTEYSVLIHGVKGGLLSSPLGFTT

539 MLPAPKNLVVSRVTEDSARLSWTAPDAAFDSFYIAYAEPRPDGEAIQLVVPGS
ERSYDLTGLKPGTEYSVLIHGVKGGLLSSPLYAIFTT

540 MLPAPKNLVVSRVTEDSARLSWTAPDAAFDSFYIAYAEPRPDGEAISLSVPGSE
RSYDLTGLKPGTEYSVLIHGVKGGLLSSPLHAKFTT

541 MLPAPKNLVVSRVTEDSARLSWTAPDAAFDSFFIGYLEPQPPGEAIHLGVPGSE
RSYDLTGLKPGTEYNVTIQGVKGGFPSIPLFASFTT

542 MLPAPKNLVVSRVTEDSARLSWTAPDAAFDSFYIAYAEPRPDGEAIQLLVPGSE
RSYDLTGLKPGTEYSVLIHGVKGGLLSSPLYAAFTT

543 MLPAPKNLVVSRVTEDSARLSWTAPDAAFDSFFIGYLEPQPPGEAIHLAVPGSE
RSYDLTGLKPGTEYNVTIQGVKGGFPSVPLAAVFTT

544 MLPAPKNLVVSRVTEDSARLSWTAPDAAFDSFYIAYAEPRPDGEAISLQVPGSE
RSYDLTGLKPGTEYSVLIHGVKGGLLSSPLGAHFTT

545 MLPAPKNLVVSRVTEDSARLSWTAPDAAFDSFYIAYAEPRPDGEAIALWVPGS
ERSYDLTGLKPGTEYSVLIHGVKGGLLSSPLVASFTT

546 MLPAPKNLVVSRVTEDSARLSWTAPDAAFDSFYIAYAEPRPDGEAIQLHVPGS
ERSYDLTGLKPGTEYSVLIHGVKGGLLSSPLYAFFTT

547 MLPAPKNLVVSRVTEDSARLSWTAPDAAFDSFYIAYAEPRPDGEAILLHVPGSE
RSYDLTGLKPGTEYSVLIHGVKGGLLSSPLRASFTT

548 MLPAPKNLVVSRVTEDSARLSWTAPDAAFDSFYIAYAEPRPDGEAIWLGVPGS
ERSYDLTGLKPGTEYSVLIHGVKGGLLSSPLHATFTT

549 MLPAPKNLVVSRVTEDSARLSWTAPDAAFDSFYIAYAEPRPDGEAIVLEVPGSE
RSYDLTGLKPGTEYSVLIHGVKGGLLSSPLHANFTT

550 MLPAPKNLVVSRVTEDSARLSWTAPDAAFDSFYIAYAEPRPDGEAILLRVPGSE
RSYDLTGLKPGTEYSVLIHGVKGGLLSSPLYAKFTT

551 MLPAPKNLVVSRVTEDSARLSWTAPDAAFDSFFIGYLEPQPPGEAIGLWVPGSE
RSYDLTGLKPGTEYNVTIQGVKGGFPSDPLQAVFTT

TABLE 4-continued

CD71-binding FN3 domain sequences

SEQ ID  Amino Acid sequence of FN3 domains that bind to CD71

552  MLPAPKNLVVSRVTEDSARLSWTAPDAAFDSFYIAYAEPRPDGEAIVLHVPGS
ERSYDLTGLKPGTEYSVLIHGVKGGLLSSPLDAFFTT

553  MLPAPKNLVVSRVTEDSARLSWTAPDAAFDSFYIAYAEPRPDGEAIILHVPGSE
RSYDLTGLKPGTEYSVLIHGVKGGLLSSPLDAYFTT

554  MLPAPKNLVVSRVTEDSARLSWTAPDAAFDSFYIAYAEPRPDGEAILLAVPGSE
RSYDLTGLKPGTEYSVLIHGVKGGLLSSPLSAKFTT

555  MLPAPKNLVVSRVTEDSARLSWTAPDAAFDSFFIGYLEPQPPGEAILLFVPGSE
RSYDLTGLKPGTEYNVTIQGVKGGFPSTPLSASFTT

556  MLPAPKNLVVSRVTEDSARLSWTAPDAAFDSFYIAYAEPRPDGEAIQLTVPGSE
RSYDLTGLKPGTEYSVLIHGVKGGLLSSPLHAYFTT

557  MLPAPKNLVVSRVTEDSARLSWTAPDAAFDSFYIAYAEPRPDGEAIQLGVPGS
ERSYDLTGLKPGTEYSVLIHGVKGGLLSSPLRAYFTT

558  MLPAPKNLVVSRVTEDSARLSWTAPDAAFDSFYIAYAEPRPDGEAILLEVPGSE
RSYDLTGLKPGTEYSVLIHGVKGGLLSSPLVAFFTT

559  MLPAPKNLVVSRVTEDSARLSWTAPDAAFDSFYIAYAEPRPDGEAIQLGVPGS
ERSYDLTGLKPGTEYSVLIHGVKGGLLSSPLLAVFTT

560  MLPAPKNLVVSRVTEDSARLSWTAPDAAFDSFYIAYAEPRPDGEAIHLRVPGS
ERSYDLTGLKPGTEYNVTIQGVKGGFPSMPLSAIFTT

561  MLPAPKNLVVSRVTEDSARLSWTAPDAAFDSFYIAYAEPRPDGEAILLQVPGSE
RSYDLTGLKPGTEYSVLIHGVKGGLLSSPLIAKFTT

562  MLPAPKNLVVSRVTEDSARLSWTAPDAAFDSFYIAYAEPRPDGEAIVLHVPGS
ERSYDLTGLKPGTEYSVLIHGVKGGLLSSPLQAIFTT

563  MLPAPKNLVVSRVTEDSARLSWTAPDAAFDSFYIAYAEPRPDGEAIALVVPGS
ERSYDLTGLKPGTEYSVLIHGVKGGLLSSPLAANFTT

564  MLPAPKNLVVSRVTEDSARLSWTAPDAAFDSFYIAYAEPRPDGEAINLSVPGSE
RSYDLTGLKPGTEYSVLIHGVKGGLLSSPLDAYFTT

565  MLPAPKNLVVSRVTEDSARLSWTAPDAAFDSFYIAYAEPRPDGEAIVLEVPGSE
RSYDLTGLKPGTEYSVLIHGVKGGLLSSPLTASFTT

566  MLPAPKNLVVSRVTEDSARLSWTAPDAAFDSFYIAYAEPRPDGEAIRLQVPGS
ERSYDLTGLKPGTEYSVLIHGVKGGLLSSPLGASFTT

567  MLPAPKNLVVSRVTEDSARLSWTAPDAAFDSFYIAYAEPRPDGEAIGLWVPGS
ERSYDLTGLKPGTEYSVLIHGVKGGLLSSPLVAYFTT

568  MLPAPKNLVVSRVTEDSARLSWTAPDAAFDSFYIAYAEPRPDGEAIYLEVPGSE
RSYDLTGLKPGTEYSVLIHGVKGGLLSSPLFTT

569  MLPAPKNLVVSRVTEDSARLSWTAPDAAFDSFYIAYAEPRPDGEAIWLDVPGS
ERSYDLTGLKPGTEYSVLIHGVKGGLLSSPLDAYFTT

570  MLPAPKNLVVSRVTEDSARLSWTAPDAAFDSFAIEYCETKMCGEAIVLTVPGS
ERSYDLTGLKPGTEYRVPIPGVKGGTASLPLSAIFTT

571  MLPAPKNLVVSRVTEDSARLSWTAPDAAFDSFFIYYIESYPAGEAIVLTVPGSE
RSYDLTGLKPGTEYWVGIDGVKGGRWSTPLSAIFTT

572  MLPAPKNLVVSRVTEDSARLSWTAPDAAFDSFFIYYIESYPAGEAIVLTVPGSC
RSYDLTGLKPGTEYWVGIDGVKGGRWSTPLSAIFTT

592  MLPAPKNLVVSRVTEDSARLSWTAPDAAFDSFAIVYHEPRPDGEAIVLTVPGS
CRSYDLTGLKPGTEYEVVILGVKGGVHSYPLSAIFTTAPAPAPAPAPLPAPKNL
VVSRVTEDSARLSWTAPDAAFDSFAIVYHEPRPDGEAIVLTVPGSERSYDLTGL
KPGTEYEVVILGVKGGVHSYPLSAIFTT

593  MLPAPKNLVVSRVTEDSARLSWTAPDAAFDSFAIVYHEPRPDGEAIVLTVPGS
CRSYDLTGLKPGTEYEVVILGVKGGVHSYPLSAIFTTGGGSGGGGSGGGGSG
GGGSLPAPKNLVVSRVTEDSARLSWTAPDAAFDSFAIVYHEPRPDGEAIVLTVP
GSERSYDLTGLKPGTEYEVVILGVKGGVHSYPLSAIFTT

TABLE 4-continued

CD71-binding FN3 domain sequences

| SEQ ID | Amino Acid sequence of FN3 domains that bind to CD71 |
|---|---|
| 594 | MLPAPKNLVVSRVTEDSARLSWTAPDAAFDSFAIVYHEPRPDGEAIVLTVPGSCRSYDLTGLKPGTEYEVVILGVKGGVHSYPLSAIFTTEAAAKEAAAKEAAAKEAAAKLPAPKNLVVSRVTEDSARLSWTAPDAAFDSFAIVYHEPRPDGEAIVLTVPGSERSYDLTGLKPGTEYEVVILGVKGGVHSYPLSAIFTT |
| 595 | MLPAPKNLVVSRVTEDSARLSWTAPDAAFDSFAIVYHEPRPDGEAIVLTVPGSCRSYDLTGLKPGTEYEVVILGVKGGVHSYPLSAIFTTEAAAKLPAPKNLVVSRVTEDSARLSWTAPDAAFDSFAIVYHEPRPDGEAIVLTVPGSERSYDLTGLKPGTEYEVVILGVKGGVHSYPLSAIFTT |
| 596 | MLPAPKNLVVSRVTEDSARLSWTAPDAAFDSFKIEYFEYVGYGEAIVLTVPGSCRSYDLTGLKPGTEYYVAIYGVKGGWYSRPLSAIFTTAPAPAPAPAPLPAPKNLVVSRVTEDSARLSWTAPDAAFDSFKIEYFEYVGYGEAIVLTVPGSERSYDLTGLKPGTEYYVAIYGVKGGWYSRPLSAIFTT |
| 597 | MLPAPKNLVVSRVTEDSARLSWTAPDAAFDSFKIEYFEYVGYGEAIVLTVPGSCRSYDLTGLKPGTEYYVAIYGVKGGWYSRPLSAIFTTGGGGSGGGGSGGGGSGGGGSLPAPKNLVVSRVTEDSARLSWTAPDAAFDSFKIEYFEYVGYGEAIVLTVPGSERSYDLTGLKPGTEYYVAIYGVKGGWYSRPLSAIFTT |
| 598 | MLPAPKNLVVSRVTEDSARLSWTAPDAAFDSFKIEYFEYVGYGEAIVLTVPGSCRSYDLTGLKPGTEYYVAIYGVKGGWYSRPLSAIFTTEAAAKEAAAKEAAAKEAAAKLPAPKNLVVSRVTEDSARLSWTAPDAAFDSFKIEYFEYVGYGEAIVLTVPGSERSYDLTGLKPGTEYYVAIYGVKGGWYSRPLSAIFTT |
| 599 | MLPAPKNLVVSRVTEDSARLSWTAPDAAFDSFKIEYFEYVGYGEAIVLTVPGSCRSYDLTGLKPGTEYYVAIYGVKGGWYSRPLSAIFTTEAAAKLPAPKNLVVSRVTEDSARLSWTAPDAAFDSFKIEYFEYVGYGEAIVLTVPGSERSYDLTGLKPGTEYYVAIYGVKGGWYSRPLSAIFTT |
| 708 | MLPAPKNLVVSRVTEDSARLSWTAPDAAFDSFAIVYHEPRPDGEAIVLTVPGSCRSYDLTGLKPGTEYEVVILGVKGGVHSYPLSAIFTT |
| 709 | MLPAPKNLVVSRVTEDSARLSWTAPDAAFDSFAIVYHEPRPDGEAIVLTVPGSERSYDLTGLKPGTEYEVVILGVKGGVHSYPLSAIFTT |
| 710 | MLPAPKNLVVSRVTEDSARLSWTAPDAAFDSFFIGYLEPQPPGEAIHLGVPGSCRSYDLTGLKPGTEYNVTIQGVKGGFPSIPLFASFTT |

As provided herein, in some embodiments, the FN3 domain that binds to CD71 binds to SEQ ID NO: 2 (human mature CD71) or SEQ ID NO: 5 (human mature CD71 extracellular domain), sequence of each provided below:

2
MTKEYQDLQHLDNEESDHHQLRKGPPPPQPLLQRLCSGPRLLLLSLGLSL

LLLVVVCVIGSQNSQLQEELRGLRETFSNFTASTEAQVKGLSTQGGNVGR

KMKSLESQLEKQQKDLSEDHSSLLLHVKQFVSDLRSLSCQMAALQGNGSE

RTCCPVNWVEHERSCYWFSRSGKAWADADNYCRLEDAHLVVVTSWEEQKF

VQHHIGPVNTWMGLHDQNGPWKWVDGTDYETGFKNWRPEQPDDWYGHGLG

GGEDCAHFTDDGRWNDDVCQRPYRWVCETELDKASQEPPLL

5
QNSQLQEELRGLRETFSNFTASTEAQVKGLSTQGGNVGRKMKSLESQLEK

QQKDLSEDHSSLLLHVKQFVSDLRSLSCQMAALQGNGSERTCCPVNWVEH

ERSCYWFSRSGKAWADADNYCRLEDAHLVVVTSWEEQKFVQHHIGPVNTW

MGLHDQNGPWKWVDGTDYETGFKNWRPEQPDDWYGHGLGGGEDCAHFTDD

GRWNDDVCQRPYRWVCETELDKASQEPPLL

In some embodiments, the FN3 domain comprises two FN3 domains connected by a linker. The linker can be a flexible linker. The linker can be a short peptide sequence, such as those described herein. For example, the linker can be a G/S or G/A linker and the like. As provided herein, the linker can be, for example, $(GS)_2$, (SEQ ID NO:720), $(GGGS)_2$ (SEQ ID NO:721), $(GGGGS)_5$ (SEQ ID NO:722), $(AP)_{2-20}$ (SEQ ID NO: 1067), $(AP)_2$ (SEQ ID NO:723), $(AP)_5$ (SEQ ID NO:724), $(AP)_{10}$ (SEQ ID NO:725), $(AP)_{20}$ (SEQ ID NO:726) and $A(EAAAK)_5AAA$ (SEQ ID NO:727) or $(EAAAK)_{1-5}$ (SEQ ID NO: 728). These are non-limiting examples and other linkers can also be used. The number of GGGGS (SEQ ID NO: 1068) or GGGGA (SEQ ID NO: 1069) repeats can also be 1, 2, 3, 4, or 5. In some embodiments, the linker comprises one or more GGGGS (SEQ ID NO: 1068) repeats and one or more GGGGA (SEQ ID NO: 1069) repeats. In some embodiments, the linker comprises EAAAKEAAAKEAAAKEAAAK (SEQ ID NO: 729); GGGGSGGGGSGGGGSGGGGS (SEQ ID NO: 730); APAPAPAPAP (SEQ ID NO: 731); or EAAAK (SEQ ID NO: 732).

In some embodiments, the FN3 domain comprising two FN3 domains connected by a linker have the amino acid sequence of SEQ ID NO: 592. In some embodiments, the FN3 domain comprising two FN3 domains connected by a linker have the amino acid sequence of SEQ ID NO: 593. In some embodiments, the FN3 domain comprising two FN3 domains connected by a linker have the amino acid sequence of SEQ ID NO: 594. In some embodiments, the FN3 domain comprising two FN3 domains connected by a linker have the amino acid sequence of SEQ ID NO: 595, In some embodiments, the FN3 domain comprising two FN3 domains connected by a linker have the amino acid sequence of SEQ ID NO: 596. In some embodiments, the FN3 domain comprising two FN3 domains connected by a linker have the amino acid sequence of SEQ ID NO: 597. In some embodiments, the FN3 domain comprising two FN3 domains connected by a linker have the amino acid sequence of SEQ ID NO: 598. In some embodiments, the FN3 domain comprising two FN3 domains connected by a linker have the amino acid sequence of SEQ ID NO: 599. In some embodiments, the FN3 domain comprising two FN3 domains connected by a linker have the amino acid sequence of one of SEQ ID Nos: 592-599.

In some embodiments, the FN3 domains may bind CD71, as applicable, with a dissociation constant ($K_D$) of less than about $1\times10^{-7}$M, for example less than about $1\times10^{-8}$ M, less than about $1\times10^{-9}$M, less than about $1\times10^{-10}$ M, less than about $1\times10^{-11}$ M, less than about $1\times10^{-12}$M, or less than about $1\times10^{-13}$M as determined by surface plasmon resonance or the Kinexa method, as practiced by those of skill in the art. The measured affinity of a particular FN3 domain-antigen interaction can vary if measured under different conditions (e.g., osmolarity, pH). Thus, measurements of affinity and other antigen-binding parameters (e.g., $K_D$, $K_{on}$, $K_{off}$) are made with standardized solutions of protein scaffold and antigen, and a standardized buffer, such as the buffers described herein.

In some embodiments, the FN3 domain may bind to its target protein at least 5-fold above the signal obtained for a negative control in a standard solution ELISA assay.

In some embodiments, the FN3 domain that binds or specifically binds its target protein comprises an initiator methionine (Met) linked to the N-terminus of the molecule. In some embodiments, the FN3 domain that binds or specifically binds to its target protein comprises a cysteine (Cys) linked to a C-terminus of the FN3 domain. The addition of the N-terminal Met and/or the C-terminal Cys may facilitate expression and/or conjugation of half-life extending molecules.

The FN3 domain can also contain cysteine substitutions, such as those that are described in U.S. Pat. No. 10,196,446, which is hereby incorporated by reference in its entirety. Briefly, in some embodiments, the polypeptide comprising an FN3 domain can have an FN3 domain that has a residue substituted with a cysteine, which can be referred to as a cysteine engineered fibronectin type III (FN3) domain. In some embodiments, the FN3 domain comprises at least one cysteine substitution at a position selected from the group consisting of residues 6, 8, 10, 11, 14, 15, 16, 20, 30, 34, 38, 40, 41, 45, 47, 48, 53, 54, 59, 60, 62, 64, 70, 88, 89, 90, 91, and 93 of the FN3 domain based on SEQ ID NO: 1 (LPAPKNLVVSEVTEDSLRLSWTAPDAAF-DSFLIQYQESEKVGEAINLTVPGSERSYDLTG LKPGTEYTVSIYGVKGGHRSNPLSAEFTT) of U.S. Pat. No. 10,196,446, which is hereby incorporated by reference in its entirety, and the equivalent positions in related FN3 domains. A cysteine substitution at a position in the domain or protein comprises a replacement of the existing amino acid residue with a cysteine residue. Other examples of cysteine modifications can be found in, for example, U.S. Patent Application Publication No. 20170362301, which is hereby incorporated by reference in its entirety. The alignment of the sequences can be performed using BlastP using the default parameters at, for example, the NCBI website.

In some embodiments, the FN3 domain that binds to the target protein is internalized into a cell. In some embodiments, internalization of the FN3 domain may facilitate delivery of a detectable label or therapeutic into a cell. In some embodiments, internalization of the FN3 domain may facilitate delivery of a cytotoxic agent into a cell. The cytotoxic agent can act as a therapeutic agent. In some embodiments, internalization of the FN3 domain may facilitate the delivery of any detectable label, therapeutic, and/or cytotoxic agent disclosed herein into a cell. In some embodiments, the cell is a tumor cell. In some embodiments, the cell is a liver cell, a lung cell, muscle cell, an immune cell, a dendritic cell, a cell of the CNS, or a heart cell. In some embodiments, the therapeutic is a siRNA molecule as provided for herein. The FN3 domains that bind CD71 conjugated to a detectable label can be used to evaluate expression of CD71 on samples such as tumor tissue in vivo or in vitro. The FN3 domains that bind CD71 conjugated to a detectable label can be used to evaluate expression of CD71 on samples blood, immune cells, muscle cells, or dendritic cells in vivo or in vitro.

As provided herein, the different FN3 domains that are linked to the siRNA molecule can also be conjugated or linked to another FN3 domain that binds to a different target. This would enable the molecule to be multi-specific (e.g. bi-specific, tri-specific, etc..), such that it binds to a first target and another, for example, target. In some embodiments, the first FN3 binding domain is linked to another FN3 domain that binds to an antigen expressed by a tumor cell (tumor antigen).

In some embodiments, FN3 domains can be linked together by a linker to form a bivalent FN3 domain. The linker can be a flexible linker. In some embodiments, the linker is a G/S linker. In some embodiments the linker has 1, 2, 3, or 4 G/S repeats. A G/S repeat unit is four glycines followed by a serine, e.g. GGGGS (SEQ ID NO: 1068). Other examples of linkers are provided herein and can also be used.

In some embodiments, the linker is a polypeptide of $(GS)_2$, (SEQ ID NO:720), $(GGGS)_2$ (SEQ ID NO:721), $(GGGGS)_5$ (SEQ ID NO:722), $(AP)_{2-20}$ (SEQ ID NO: 1067), $(AP)_2$(SEQ ID NO:723), $(AP)_5$ (SEQ ID NO:724), $(AP)_{10}$ (SEQ ID NO:725), $(AP)_{20}$ (SEQ ID NO:726) and $A(EAAAK)_5AAA$ (SEQ ID NO:727) or $(EAAAK)_{1-5}$ (SEQ ID NO: 728). These are non-limiting examples and other linkers can also be used. The number of GGGGS (SEQ ID NO: 1068) or GGGGA (SEQ ID NO: 1069) repeats can also be 1, 2, 3, 4, or 5. In some embodiments, the linker comprises one or more GGGGS (SEQ ID NO: 1068) repeats and one or more GGGGA (SEQ ID NO: 1069) repeats. In some embodiments, the linker comprises one or more GGGGS (SEQ ID NO: 1068) repeats and one or more EAAAK (SEQ ID NO: 732) repeats. In some embodiments, the linker comprises one or more GGGGS (SEQ ID NO: 1068) repeats and one or more "AP" repeats. In some embodiments, the linker comprises EAAAKEAAAKEAAAKEAAAK (SEQ ID NO: 729); GGGGSGGGGSGGGGSGGGGS (SEQ ID NO: 730); APAPAPAPAP (SEQ ID NO: 731); or EAAAK (SEQ ID NO: 732).

Without being bound to any particular theory, in some embodiments, the FN3 domains that are linked to the nucleic acid molecule may be used in the targeted delivery of the therapeutic agent to cells that express the binding partner of the one or more FN3 domains(e.g. tumor cells), and lead intracellular accumulation of the nucleic acid molecule therein. This can allow the siRNA molecule to properly interact with the cell machinery to inhibit the expression of the target gene, improve efficacy, and also avoid, in some embodiments, toxicity that may arise with untargeted administration of the same siRNA molecule.

The FN3 domain described herein that bind to their specific target protein may be generated as monomers, dimers, or multimers, for example, as a means to increase the valency and thus the avidity of target molecule binding, or to generate bi- or multispecific scaffolds simultaneously binding two or more different target molecules. The dimers and multimers may be generated by linking monospecific, bi- or multispecific protein scaffolds, for example, by the inclusion of an amino acid linker, for example a linker containing poly-glycine, glycine and serine, or alanine and proline. Exemplary linker include $(GS)_2$, (SEQ ID NO:720), $(GGGS)_2$ (SEQ ID NO:721), $(GGGGS)_5$ (SEQ ID NO:722), $(AP)_{2-20}$ (SEQ ID NO: 1067), $(AP)_2$ (SEQ ID NO:723), $(AP)_5$ (SEQ ID NO:724), $(AP)_{10}$ (SEQ ID NO:725), $(AP)_{20}$ (SEQ ID NO:726) and $A(EAAAK)_5AAA$ (SEQ ID NO:727) or $(EAAAK)_{1-5}$ (SEQ ID NO: 728). In some embodiments, the linker comprises or is an amino acid sequence of: EAAAKEAAAKEAAAKEAAAK (SEQ ID NO: 729); GGGGSGGGGSGGGGSGGGGS (SEQ ID NO: 730); APAPAPAPAP (SEQ ID NO: 731); or EAAAK (SEQ ID NO: 732).

The dimers and multimers may be linked to each other in a N-to C-direction. The use of naturally occurring as well as synthetic peptide linkers to connect polypeptides into novel linked fusion polypeptides is well known in the literature (Hallewell et al., J Biol Chem 264, 5260-5268, 1989; Alfthan et al., Protein Eng. 8, 725-731, 1995; Robinson & Sauer, Biochemistry 35, 109-116, 1996; U.S. Pat. No. 5,856, 456). The linkers described in this paragraph may be also be used to link the domains provided in the formula provided herein and above.

Half-Life Extending Moieties

The FN3 domains may also, in some embodiments, incorporate other subunits for example via covalent interaction. In some embodiments, the FN3 domains that further comprise a half-life extending moiety. Exemplary half-life extending moieties are albumin, albumin variants, albumin-binding proteins and/or domains, transferrin and fragments and analogues thereof, and Fc regions. Amino acid sequences of the human Fc regions are well known, and include IgG1, IgG2, IgG3, IgG4, IgM, IgA and IgE Fc regions. In some embodiments, the FN3 domain binds to albumin, albumin variants, albumin-binding proteins and/or domains, and fragments and analogues thereof. extending the half-life of the entire molecule.

In some embodiments, the albumin binding domain comprises the amino acid sequence of SEQ ID NOs: 101, 102, 103, 104, 105, 106, 107, 108, 109, 110, 111, 112, 113, 114, 115, 116, 117, 118, or 119. In some embodiments, the albumin binding domain (protein) is isolated. In some embodiments, the albumin binding domain comprises an amino acid sequence that is at least, or is, 85%, 86%, 87%, 88%, 89%, 90%, 91%, 92%, 93%, 94%, 95%, 96%, 97%, 98%, or 99% identical to the amino acid sequence of SEQ ID NO: 101, 102, 103, 104, 105, 106, 107, 108, 109, 110, 111, 112, 113, 114, 115, 116, 117, 118, or 119. In some embodiments, the albumin binding domain comprises an amino acid sequence that is at least, or is, 85%, 86%, 87%, 88%, 89%, 90%, 901%, 92%, 93%, 94%, 95%, 96%, 97%, 98%, or 99% identical to the amino acid sequence of SEQ ID NO: 101, 102, 103, 104, 105, 106, 107, 108, 109, 110, 111, 112, 113, 114, 115, 116, 117, 118, or 119 provided that the protein has a substitution that corresponds to position 10 of SEQ ID NO: 101, 102, 103, 104, 105, 106, 107, 108, 109, 110, 111, 112, 113, 114, 115, 116, 117, 118, or 119. In some embodiments, the substitution is A10V. In some embodiments, the substitution is A10G, A10L, A10I, A10T, or A10S. In some embodiments, the substitution at position 10 is any naturally occurring amino acid. In some embodiments, the isolated albumin binding domain comprises an amino acid sequence that has 1, 2, 3, 4, 5, 6, 7, 8, 9, 10, 11, 12, 13, or 14 substitutions when compared to the amino acid sequence of SEQ ID NOs: 101, 102, 103, 104, 105, 106, 107, 108, 109, 110, 111, 112, 113, 114, 115, 116, 117, 118, or 119. In some embodiments, the substitution is at a position that corresponds to position 10 of SEQ ID NOs: 101, 102, 103, 104, 105, 106, 107, 108, 109, 110, 111, 112, 113, 114, 115, 116, 117, 118, or 119. In some embodiments, FN3 domains provided comprises a cysteine residue in at least one residue position corresponding to residue positions 6, 11, 22, 25, 26, 52, 53, 61, 88 or positions 6, 8, 10, 11, 14, 15, 16, 20, 30, 34, 38, 40, 41, 45, 47, 48, 53, 54, 59, 60, 62, 64, 70, 88, 89, 90, 91, or 93 of SEQ ID NO: 101, 102, 103, 104, 105, 106, 107, 108, 109, 110, 111, 112, 113, 114, 115, 116, 117, 118, or 119, or at a C-terminus. Although the positions are listed in a series, each position can also be chosen individually. In some embodiments, the cysteine is at a position that corresponds to position 6, 53, or 88. In some embodiments, additional examples of albumin binding domains can be found in U.S. Pat. No. 10,925,932, which hereby incorporated by reference.

All or a portion of an antibody constant region may be attached to the FN3 domain to impart antibody-like properties, especially those properties associated with the Fc region, such as Fc effector functions such as C1q binding, complement dependent cytotoxicity (CDC), Fc receptor binding, antibody-dependent cell-mediated cytotoxicity (ADCC), phagocytosis, down regulation of cell surface receptors (e.g., B cell receptor; BCR), and may be further modified by modifying residues in the Fc responsible for these activities (for review; see Strohl, *Curr Opin Biotechnol.* 20, 685-691, 2009).

Additional moieties may be incorporated into the FN3 domains such as polyethylene glycol (PEG) molecules, such as PEG5000 or PEG20,000, fatty acids and fatty acid esters of different chain lengths, for example laurate, myristate, stearate, arachidate, behenate, oleate, arachidonate, octanedioic acid, tetradecanedioic acid, octadecanedioic acid, docosanedioic acid, and the like, polylysine, octane, carbohydrates (dextran, cellulose, oligo- or polysaccharides) for desired properties. These moieties may be direct fusions with the protein scaffold coding sequences and may be generated by standard cloning and expression techniques. Alternatively, well known chemical coupling methods may be used to attach the moieties to recombinantly produced molecules disclosed herein.

A PEG moiety may for example be added to the FN3 domain t by incorporating a cysteine residue to the C-terminus of the molecule, or engineering cysteines into residue positions that face away from the binding face of the molecule, and attaching a PEG group to the cysteine using well known methods.

FN3 domains incorporating additional moieties may be compared for functionality by several well-known assays. For example, altered properties due to incorporation of Fc domains and/or Fc domain variants may be assayed in Fc receptor binding assays using soluble forms of the receptors, such as the FcγRI, FcγRII, FcγRIII or FcRn receptors, or using well known cell-based assays measuring for example ADCC or CDC, or evaluating pharmacokinetic properties of the molecules disclosed herein in in vivo models.

The compositions provided herein can be prepared by preparing the FN3 proteins and the nucleic acid molecules and linking them together. The techniques for linking the proteins to a nucleic acid molecule are known and any method can be used. For example, in some embodiments, the nucleic acid molecule is modified with a linker, such as the linker provided herein, and then the protein is mixed with the nucleic acid molecule comprising the linker to form the composition. For example, in some embodiments, a FN3 domains is conjugated to a siRNA a cysteine using thiol-maleimide chemistry. In some embodiments, a cysteine-containing FN3 domain can be reduced in, for example, phosphate buffered saline (or any other appropriate buffer) with a reducing agent (e.g. tris(2-carboxyethyl) phosphine (TCEP)) to yield a free thiol. Then, in some embodiments, the free thiol containing FN3 domain was mixed with a maleimide linked-modified siRNA duplex and incubated under conditions to form the linked complex. In some embodiments, the mixture is incubated for 0-5 hr, or about 1, 2, 3, 4 or 5 hr at RT. The reaction can be, for example, quenched with N-ethyl maleimide. In some embodiments, the conjugates can be purified using affinity chromatography and ion exchange. Other methods can also be used and this is simply one non-limiting embodiment.

Methods of making FN3 proteins are known and any method can be used to produce the protein. Examples are provided in the references incorporated by reference herein.

In some embodiments, the FN3 domain specifically binding CD71 comprises the amino acid sequence of SEQ ID NOs: 301-301, 310, 312-519, 521-572, 592-599, or 708-710, wherein a histidine tag has been appended to the N-terminal or C-terminal end of the polypeptide for ease of purification. In some embodiments, the histidine tag (His-tag) comprises six histidine residues (SEQ ID NO: 1070). In further embodiments, the His-tag to connected to the FN3 domain by at least one glycine residue or about 2 to about 4 glycine residues. Accordingly, after purification of the FN3 domain and cleavage of the His-tag from the polypeptide one or more glycine may be left on the N-terminus or C-terminus. In some embodiments, if the His-tag is removed from the N-terminus all of the glycines are removed. In some embodiments, if the His-tag is removed from the C-terminus one or more of the glycines are retained.

In some embodiments, the FN3 domain specifically binding CD71 comprises the amino acid sequence of SEQ ID NOs: 301-301, 310, 312-519, 521-572, 592-599, or 708-710, wherein the N-terminal methionine is retained after purification of the FN3 domain.

Kits

In some embodiments, a kit comprising the compositions described herein are provided.

The kit may be used for therapeutic uses and as a diagnostic kit.

In some embodiments, the kit comprises the FN3 domain conjugated to the nucleic acid molecule.

Uses of the Conjugates FN3 Domains

The compositions provided for herein may be used to diagnose, monitor, modulate, treat, alleviate, help prevent the incidence of, or reduce the symptoms of human disease or specific pathologies in cells, tissues, organs, fluid, or, generally, a host.

In some embodiments, methods of selectively reducing GYS1 mRNA and protein in skeletal muscle. In certain embodiments, GYS1 mRNA and protein is not reduced in the liver and/or the kidney.

In some embodiments, the reduction in the GYS1 mRNA and protein is sustained for about 1 week, about 2 weeks, about 3 weeks, about 4 weeks, about 5 weeks, or greater than 5 weeks after administration of the conjugate described herein.

In some embodiments, the FN3 domain can facilitate delivery into CD71 positive tissues (eg. skeletal muscle, smooth muscle) for treatment of muscle diseases.

In some embodiments, the FN3 domain can facilitate delivery to activated lymphocytes, dendritic cells, or other immune cells for treatment of immunological diseases.

In some embodiments, the polypeptide that binds to CD71 is directed to immune cells. In some embodiments, the polypeptide that binds to CD71 is directed to dendritic cells. In some embodiments, methods of treating an autoimmune disease in a subject in need thereof are provided. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent. In some embodiments, the autoimmune disease is selected from the group consisting of rheumatoid arthritis, Hashimoto's autoimmune thyroiditis, celiac disease, diabetes mellitus type 1, vitiligo, rheumatic fever, pernicious anemia/atrophic gastritis, alopecia areata, and immune thrombocytopenic purpura.

In some embodiments, a method of treating a subject having Pompe Disease (GSD2, acid alpha-glucosidase (GAA) deficiency) is provided, the method comprising administering to the subject a composition provided for herein. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent.

In some embodiments, methods of treating glycogen storage disease in a subject in need thereof, the method comprising administering a composition provided herein are provided. In some embodiments, the glycogen storage disease is selected from the group consisting of Cori's disease or Forbes' disease (GSD3, Glycogen debranching enzyme (AGL) deficiency), McArdle disease (GSD5, Muscle glycogen phosphorylase (PYGM) deficiency), type II Diabetes/diabetic nephropathy, Aldolase A Deficiency GSD12, Lafora Disease, hypoxia, Andersen disease (GSD4, Glycogen debranching enzyme (GBE1) deficiency), Tarui's Disease (GSD7, Muscle phosphofructokinase (PFKM) deficiency), and adult polyglucosan body disease. In some embodiments, the glycogen storage disease is selected from the group consisting of Glycogen synthase (GYS2) deficiency (GSD0), Glucose-6-phosphatase (G6PC/SLC37A4) deficiency (GSD1, von Gierke's disease), Hers' disease (GSD6, Liver glycogen phosphorylase (PYGL) or Muscle phosphoglycerate mutase (PGAM2) deficiency), Phosphorylase kinase (PHKA2/PHKB/PHKG2/PHKA1) deficiency (GSD9), Phosphoglycerate mutase (PGAM2) deficiency (GSD10), Muscle lactate dehydrogenase (LDHA) deficiency (GSD11), Fanconi-Bickel syndrome (GSD 11, Glucose transporter (GLUT2) deficiency, Aldolase A deficiency (GSD 12), β-enolase (ENO3) deficiency (GSD13), and Glycogenin-1 (GYG1) deficiency (GSD15).

In some embodiments, a use of a composition as provided herein or of any of in the preparation of a pharmaceutical composition or medicament for treating cancer are provided. In some embodiments, the cancer is selected from the group consisting of acute myeloid leukemia, myelodysplastic syndromes, gastric cancer, clear cell renal cell carcinoma, clear cell carcinomas of the breast, clear cell carcinomas of the endometrium, clear cell carcinomas of the ovary, clear cell carcinomas of the uterus, hepatocellular carcinoma, pancreatic cancer, prostate cancer, soft tissue cancer, Ewings sarcoma, and non-small cell lung cancer In some embodiments, the CD71 cell is a cell involved in a CNS diseases, inflammatory/immune diseases, such as MS & infectious diseases of the brain. In some embodiments, the polypeptide that binds to CD71 is directed to the central nervous system. In some embodiments, methods of treating a neurological condition and/or a brain tumor in a subject in need thereof are provided. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent. In some embodiments, the brain tumor is selected from the group consisting of nonmalignant, benign, and malignant brain tumors. In some embodiments, the neurological condition is selected from the group consisting of Alzheimer's Disease, Amyotrophic Lateral Sclerosis, Parkinson's Disease, Lafora Disease, Pompe Disease, adult polyglucosan body disease, stroke, spinal cord injury, ataxia, Bell's Palsy, cerebral aneurysm, epilepsy, seizures, Guillain-Barre Syndrome, multiple sclerosis, muscular dystrophy, neurocutaneous syndromes, migraine, encephalitis, septicemia, and myasthenia gravis.

In some embodiments, a method of treating a subject having cancer is provided, the method comprising administering to the subject a composition provided for herein. In some embodiments, the method comprises administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent.

In some embodiments, the subject has a solid tumor.

In some embodiments, the solid tumor is a melanoma.

In some embodiments, the solid tumor is a lung cancer. In some embodiments, the solid tumor is a non-small cell lung cancer (NSCLC). In some embodiments, the solid tumor is a squamous non-small cell lung cancer (NSCLC). In some embodiments, the solid tumor is a non-squamous NSCLC. In some embodiments, the solid tumor is a lung adenocarcinoma.

In some embodiments, the solid tumor is a renal cell carcinoma (RCC).

In some embodiments, the solid tumor is a mesothelioma.

In some embodiments, the solid tumor is a nasopharyngeal carcinoma (NPC).

In some embodiments, the solid tumor is a colorectal cancer.

In some embodiments, the solid tumor is a prostate cancer. In some embodiments, the solid tumor is castration-resistant prostate cancer.

In some embodiments, the solid tumor is a stomach cancer.

In some embodiments, the solid tumor is an ovarian cancer.

In some embodiments, the solid tumor is a gastric cancer.

In some embodiments, the solid tumor is a liver cancer.

In some embodiments, the solid tumor is pancreatic cancer.

In some embodiments, the solid tumor is a thyroid cancer.

In some embodiments, the solid tumor is a squamous cell carcinoma of the head and neck.

In some embodiments, the solid tumor is a carcinomas of the esophagus or gastrointestinal tract.

In some embodiments, the solid tumor is a breast cancer.

In some embodiments, the solid tumor is a fallopian tube cancer.

In some embodiments, the solid tumor is a brain cancer.

In some embodiments, the solid tumor is an urethral cancer.

In some embodiments, the solid tumor is a genitourinary cancer.

In some embodiments, the solid tumor is an endometriosis.

In some embodiments, the solid tumor is a cervical cancer.

In some embodiments, the solid tumor is a metastatic lesion of the cancer.

In some embodiments, the subject has a hematological malignancy.

In some embodiments, the hematological malignancy is a lymphoma, a myeloma or a leukemia. In some embodiments, the hematological malignancy is a B cell lymphoma. In some embodiments, the hematological malignancy is Burkitt's lymphoma. In some embodiments, the hematological malignancy is Hodgkin's lymphoma. In some embodiments, the hematological malignancy is a non-Hodgkin's lymphoma.

In some embodiments, the hematological malignancy is a myelodysplastic syndrome.

In some embodiments, the hematological malignancy is an acute myeloid leukemia (AML). In some embodiments, the hematological malignancy is a chronic myeloid leukemia (CIVIL). In some embodiments, the hematological malignancy is a chronic myelomoncytic leukemia (CMML).

In some embodiments, the hematological malignancy is a multiple myeloma (MM).

In some embodiments, the hematological malignancy is a plasmacytoma.

In some embodiments, the cancer is a soft tissue cancer. In some embodiments, the soft tissue cancer is Ewings sarcoma.

In some embodiments, methods of treating cancer in a subject in need thereof are provided. In some embodiments, the methods comprise administering to the subject any composition provided herein. In some embodiments, a use of a composition as provided herein are provided in the preparation of a pharmaceutical composition or medicament for treating cancer. In some embodiments, the composition can be used for treating cancer.

In some embodiments, methods of treating Pompe Disease (GSD2, acid alpha-glucosidase (GAA) deficiency) in a subject in need thereof are provided. In some embodiments, the methods comprise administering to the subject any composition provided herein. In some embodiments, a use of a composition as provided herein are provided in the preparation of a pharmaceutical composition or medicament for treating Pompe Disease (GSD2, acid alpha-glucosidase (GAA) deficiency). In some embodiments, the composition can be used for treating Pompe Disease (GSD2, acid alpha-glucosidase (GAA) deficiency).

In some embodiments, methods of treating glycogen storage disease in a subject in need thereof are provided. In some embodiments, the methods comprise administering to the subject any composition provided herein. In some embodiments, a use of a composition as provided herein are provided in the preparation of a pharmaceutical composition or medicament for treating glycogen storage disease. In some embodiments, the composition can be used for treating glycogen storage disease.

In some embodiments, methods of treating glycogen storage disease in a subject in need thereof, the method comprising administering a composition provided herein are provided. In some embodiments, the glycogen storage disease is selected from the group consisting of Cori's disease or Forbes' disease (GSD3, Glycogen debranching enzyme (AGL) deficiency), McArdle disease (GSD5, Muscle glycogen phosphorylase (PYGM) deficiency), type II Diabetes/diabetic nephropathy, Aldolase A Deficiency GSD12, Lafora Disease, hypoxia, Andersen disease (GSD4, Glycogen debranching enzyme (GBE1) deficiency), Tarui's Disease (GSD7, Muscle phosphofructokinase (PFKM) deficiency), and adult polyglucosan body disease. In some embodiments, the glycogen storage disease is selected from the group consisting of Glycogen synthase (GYS2) deficiency (GSD0), Glucose-6-phosphatase (G6PC/SLC37A4) deficiency (GSD1, von Gierke's disease), Hers' disease (GSD6, Liver glycogen phosphorylase (PYGL) or Muscle phosphoglycerate mutase (PGAM2) deficiency), Phosphorylase kinase (PHKA2/PHKB/PHKG2/PHKA1) deficiency (GSD9), Phosphoglycerate mutase (PGAM2) deficiency (GSD10), Muscle lactate dehydrogenase (LDHA) deficiency (GSD11), Fanconi-Bickel syndrome (GSD 11, Glucose transporter (GLUT2) deficiency, Aldolase A deficiency (GSD 12), β-enolase (ENO3) deficiency (GSD13), and Glycogenin-1 (GYG1) deficiency (GSD15).

In some embodiments, the polypeptide that binds to CD71 is directed to the central nervous system. In some embodiments, methods of treating a neurological condition and/or a brain tumor in a subject in need thereof are provided. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent. In some embodiments, the brain tumor is selected from the group consisting of nonmalignant, benign, and malignant brain tumors. In some embodiments, the neurological condition is selected from the group consisting of Alzheimer's Disease, Amyotrophic Lateral Sclerosis, Parkinson's Disease, Lafora Disease, Pompe Disease, adult polyglucosan body disease, stroke, spinal cord injury, ataxia, Bell's Palsy, cerebral aneurysm, epilepsy, seizures, Guillain-Barre Syndrome, multiple sclerosis, muscular dystrophy, neurocutaneous syndromes, migraine, encephalitis, septicemia, and myasthenia gravis. In some embodiments, a method of treating a neurological condition and/or a brain tumor in a subject, the method comprising administering to the subject a FN3 domain that binds CD71 and the FN3 domain is conjugated to a therapeutic agent (e.g. cytotoxic agent, an oligonucleotide, such as a siRNA, ASO, and the like, a FN3 domain that binds to another target, and the like).

In some embodiments, methods of treating Pompe disease in a subject in need thereof are provided. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent. In some embodiments, a method of treating a Pompe disease in a subject, the method comprising administering to the subject a FN3 domain that binds CD71 and the FN3 domain is conjugated to a therapeutic agent (e.g. cytotoxic agent, an oligonucleotide, such as a siRNA, ASO, and the like, a FN3 domain that binds to another target, and the like).

In some embodiments, the polypeptide that binds to CD71 is directed to immune cells. In some embodiments, the polypeptide that binds to CD71 is directed to dendritic cells. In some embodiments, methods of treating an autoimmune disease in a subject in need thereof are provided. In some embodiments, the methods comprise administering to the subject a polypeptide or the pharmaceutical composition that binds to CD71. In some embodiments, that the polypeptide is a FN3 domain that binds to CD71. In some embodiments, the polypeptide comprises a sequence such as SEQ ID Nos: 301-301, 310, 312-519, 521-572, 592-599, or 708-710, or a polypeptide as provided herein that is linked to or conjugated to a therapeutic agent. In some embodiments, the autoimmune disease is selected from the group consisting of rheumatoid arthritis, Hashimoto's autoimmune thyroiditis, celiac disease, diabetes mellitus type 1, vitiligo, rheumatic fever, pernicious anemia/atrophic gastritis, alopecia areata, and immune thrombocytopenic purpura. In some embodiments, a method of treating an autoimmune disease in a subject, the method comprising administering to the subject a FN3 domain that binds CD71 and the FN3 domain is conjugated to a therapeutic agent (e.g. cytotoxic agent, an oligonucleotide, such as a siRNA, ASO, and the like, a FN3 domain that binds to another target, and the like).

In some embodiments, methods of reducing the expression of a target gene in a cell are provided. In some embodiments, the methods comprise delivering to the cell with a composition or a pharmaceutical composition as provided herein. In some embodiments, the cell is ex-vivo. In some embodiments, the cell is in-vivo. In some embodiments, the target gene is GYS1. The target gene, however, can be any target gene as the evidence provided herein demonstrates that siRNA molecules can be delivered efficiently when conjugated to a FN3 domain. In some embodiments, the siRNA targeting GYS1 is linked to a FN3 domain. In some embodiments, the FN3 polypeptide (domain) is one that binds to CD71. In some embodiments, the FN3 polypeptide is as provided for herein or as provided for in PCT Application No. PCT/US20/55509, U.S. application Ser. No. 17/070,337, PCT Application No. PCT/US20/55470, or U.S. application Ser. No. 17/070,020, each of which is hereby incorporated by reference in its entirety. In some embodiments, the siRNA is not conjugated to a FN3 domain.

In some embodiments, methods of reducing the expression of a target gene in a cell are provided. In some embodiments, the methods comprise delivering to the cell with a composition or a pharmaceutical composition as provided herein. In some embodiments, the cell is ex-vivo. In some embodiments, the cell is in-vivo. In some embodiments, a method of reducing the expression of a target gene results in a reduction of about 99%, 90-99%, 50-90%, or 10-50% in the expression of the target gene.

In some embodiments, a method of reducing the expression of GYS1 is provided. In some embodiments, the reduced expression is the expression (amount) of GYS1 mRNA. In some embodiments, a method of reducing the expression of GYS1 results in a reduction of about 99%, 90-99%, 50-90%, or 10-50% in the expression of GYS1. In some embodiments, the reduced expression is the expression (amount) of GYS1 protein. In some embodiments, the reduced protein is glycogen. In some embodiments, reduction of glycogen occurs in muscle cells. In some embodiments, reduction of glycogen occurs in heart cells. In some embodiments, the method comprises delivering to a cell with a siRNA molecule as provided herein that targets GYS1. In some embodiments, the siRNA is conjugated to a FN3 domain. In some embodiments, the FN3 domain is a FN3 domain that binds to CD71. In some embodiments, the FN3 domain is as provided for herein. In some embodiments, the FN3 domain is a dimer of two FN3 domains that bind to CD71. In some embodiments, the FN3 domains are the same. In some embodiments, the two FN3 domains are different, i.e., bind to different regions or amino acid residues of CD71, i.e. a different epitope. In some embodiments, the method comprises administering to a subject (patient) a GYS1 siRNA molecule, such as those provided herein. In some embodiments, the GYS1 siRNA administered to the subject is conjugated or linked to a FN3 domain. In some embodiments, the FN3 domain is a FN3 domain that binds to CD71. In some embodiments, the FN3 domain is as provided for herein. In some embodiments, the FN3 domain is a dimer of two FN3 domains that bind to CD71. In some embodiments, the FN3 domains are the same. In some embodiments, the two FN3 domains are different, i.e., bind to different regions or amino acid residues of CD71, i.e. a different epitope. In some embodiments, the CD71 binding domain is a polypeptide as provided for herein.

In some embodiments, methods of delivering a siRNA molecule to a cell in a subject are provided. In some embodiments, the methods comprise administering to the subject a pharmaceutical composition comprising a composition as provided for herein. In some embodiments, the cell is a CD71 positive cell. The term "positive cell" in reference to a protein refers to a cell that expresses the protein. In some embodiments, the protein is expressed on the cell surface. In some embodiments, the cell is a tumor cell, a liver cell, an immune cell, a dendritic cell, a heart cell, a muscle cell, a cell of the CNS, or a cell inside the blood brain barrier. In some embodiments, the siRNA downregulates the expression of a target gene in the cell. In some embodiments, the target gene is GYS1.

In some embodiments, the compositions provided herein may be used to diagnose, monitor, modulate, treat, alleviate, help prevent the incidence of, or reduce the symptoms of human disease or specific pathologies in cells, tissues, organs, fluid, or, generally, a host, also exhibit the property of being able to cross the blood brain barrier. The blood-brain barrier (BBB) prevents most macromolecules (e.g., DNA, RNA, and polypeptides) and many small molecules from entering the brain. The BBB is principally composed of specialized endothelial cells with highly restrictive tight junctions, consequently, passage of substances, small and large, from the blood into the central nervous system is controlled by the BBB. This structure makes treatment and management of patients with neurological diseases and disorders (e.g., brain cancer) difficult as many therapeutic agents cannot be delivered across the BBB with desirable efficiency. Additional conditions that involve disruptions of the BBB include: stroke, diabetes, seizures, hypertensive encephalopathy, acquired immunodeficiency syndrome, traumatic brain injuries, multiple sclerosis, Lafora Disease, Pompe Disease, adult polyglucosan body disease, Parkinson's disease (PD) and Alzheimer disease. This ability is especially useful for treating brain cancers including for example: astrocytoma, medulloblastoma, glioma, ependymoma, germinoma (pinealoma), glioblastoma multiform, oligodendroglioma, schwannoma, retinoblastoma, and congenital tumors; or a cancer of the spinal cord, e.g., neurofibroma, meningioma, glioma, and sarcoma. This is further useful in treating Pompe Disease and/or glycogen storage disease. In certain embodiments, the compositions provided for herein can be used to deliver a therapeutic or cytotoxic agent, for example, across the blood brain barrier. In certain embodiments, the compositions provided for herein can be used to deliver a therapeutic or cytotoxic agent, for example, into the muscle.

In some embodiments, methods of treating glycogen storage disease in a subject in need thereof, the method comprising administering a composition provided herein are provided. In some embodiments, the glycogen storage disease is selected from the group consisting of Cori's disease or Forbes' disease (GSD3, Glycogen debranching enzyme (AGL) deficiency), McArdle disease (GSD5, Muscle glycogen phosphorylase (PYGM) deficiency), type II Diabetes/diabetic nephropathy, Aldolase A Deficiency GSD12, Lafora Disease, hypoxia, Andersen disease (GSD4, Glycogen debranching enzyme (GBE1) deficiency), Tarui's Disease (GSD7, Muscle phosphofructokinase (PFKM) deficiency), and adult polyglucosan body disease. In some embodiments, the glycogen storage disease is selected from the group consisting of Glycogen synthase (GYS2) deficiency (GSD0), Glucose-6-phosphatase (G6PC/SLC37A4) deficiency (GSD1, von Gierke's disease), Hers' disease (GSD6, Liver glycogen phosphorylase (PYGL) or Muscle phosphoglycerate mutase (PGAM2) deficiency), Phosphorylase kinase (PHKA2/PHKB/PHKG2/PHKA1) deficiency (GSD9), Phosphoglycerate mutase (PGAM2) deficiency (GSD10), Muscle lactate dehydrogenase (LDHA) deficiency (GSD11), Fanconi-Bickel syndrome (GSD 11, Glucose transporter (GLUT2) deficiency, Aldolase A deficiency (GSD 12), β-enolase (ENO3) deficiency (GSD13), and Glycogenin-1 (GYG1) deficiency (GSD15).

In some embodiments, the compositions or pharmaceutical compositions provided herein can be used to treat muscle diseases, such as muscular dystrophy, DMD, and the like.

In some embodiments, the compositions or pharmaceutical compositions provided herein may be administered alone or in combination with other therapeutics, that is, simultaneously or sequentially. In some embodiments, the other or additional therapeutics are other anti-tumor agent or therapeutics. Different tumor types and stages of tumors can require the use of various auxiliary compounds useful for treatment of cancer. For example, the compositions provided herein can be used in combination with various chemotherapeutics such as taxol, tyrosine kinase inhibitors, leucovorin, fluorouracil, irinotecan, phosphatase inhibitors, MEK inhibitors, among others. The composition may also be used in combination with drugs which modulate the immune response to the tumor such as anti-PD-1 or anti-CTLA-4, among others. Additional treatments can be agents that modulate the immune system, such antibodies that target PD-1 or PD-L1.

In some embodiments, the compositions or pharmaceutical compositions provided herein may be administered in combination with GAA enzyme replacement therapy (ERT).

"Treat" or "treatment" refers to the therapeutic treatment and prophylactic measures, wherein the object is to prevent or slow down (lessen) an undesired physiological change or disorder, such as the development or spread of cancer. In some embodiments, beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable. "Treatment" can also mean prolonging survival as compared to expected survival if not receiving treatment. Those in need of treatment include those already with the condition or disorder as well as those prone to have the condition or disorder or those in which the condition or disorder is to be prevented.

A "therapeutically effective amount" refers to an amount effective, at dosages and for periods of time necessary, to achieve a desired therapeutic result. A therapeutically effective amount of the compositions provided herein may vary according to factors such as the disease state, age, sex, and weight of the individual. Exemplary indicators of an effective amount is improved well-being of the patient, decrease or shrinkage of the size of a tumor, arrested or slowed growth of a tumor, and/or absence of metastasis of cancer cells to other locations in the body.

Administration/Pharmaceutical Compositions

In some embodiments, pharmaceutical compositions of the compositions provided herein and a pharmaceutically acceptable carrier, are provided. For therapeutic use, the compositions may be prepared as pharmaceutical compositions containing an effective amount of the domain or molecule as an active ingredient in a pharmaceutically acceptable carrier. "Carrier" refers to a diluent, adjuvant, excipient, or vehicle with which the active compound is administered. Such vehicles can be liquids, such as water and oils, including those of petroleum, animal, vegetable or synthetic origin, such as peanut oil, soybean oil, mineral oil, sesame oil and the like. For example, 0.4% saline and 0.3% glycine can be used. These solutions are sterile and generally free of particulate matter. They may be sterilized by conventional, well-known sterilization techniques (e.g., filtration). The compositions may contain pharmaceutically acceptable auxiliary substances as required to approximate physiological conditions such as pH adjusting and buffering agents, stabilizing, thickening, lubricating and coloring agents, etc. The concentration of the molecules disclosed herein in such pharmaceutical formulation can vary widely, i.e., from less than about 0.5%, usually at least about 1% to as much as 15 or 20% by weight and will be selected primarily based on required dose, fluid volumes, viscosities, etc., according to the particular mode of administration selected. Suitable vehicles and formulations, inclusive of other human proteins, e.g., human serum albumin, are described, for example, in e.g. Remington: The Science and Practice of Pharmacy, 21st Edition, Troy, D.B. ed., Lippincott Williams and Wilkins, Philadelphia, Pa. 2006, Part 5, Pharmaceutical Manufacturing pp 691-1092, See especially pp. 958-989.

The mode of administration for therapeutic use of the compositions disclosed herein may be any suitable route that delivers the agent to the host, such as parenteral administration, e.g., intradermal, intramuscular, intraperitoneal, intravenous or subcutaneous, pulmonary; transmucosal (oral, intranasal, intravaginal, rectal), using a formulation in a tablet, capsule, solution, powder, gel, particle; and contained in a syringe, an implanted device, osmotic pump, cartridge, micropump; or other means appreciated by the skilled artisan, as well known in the art. Site specific administration may be achieved by for example intrarticular, intrabronchial, intraabdominal, intracapsular, intracartilaginous, intracavitary, intracelial, intracerebellar, intracerebroventricular, intracolic, intracervical, intragastric, intrahepatic, intracardial, intraosteal, intrapelvic, intrapericardiac, intraperitoneal, intrapleural, intraprostatic, intrapulmonary, intrarectal, intrarenal, intraretinal, intraspinal, intrasynovial, intrathoracic, intrauterine, intravascular, intravesical, intralesional, vaginal, rectal, buccal, sublingual, intranasal, or transdermal delivery.

Pharmaceutical compositions can be supplied as a kit comprising a container that comprises the pharmaceutical composition as described herein. A pharmaceutical composition can be provided, for example, in the form of an injectable solution for single or multiple doses, or as a sterile powder that will be reconstituted before injection. Alternatively, such a kit can include a dry-powder disperser, liquid aerosol generator, or nebulizer for administration of a pharmaceutical composition. Such a kit can further comprise written information on indications and usage of the pharmaceutical composition.

EXAMPLES

The following examples are illustrative of the embodiments disclosed herein. These examples are provided for the purpose of illustration only and the embodiments should in no way be construed as being limited to these examples, but rather should be construed to encompass any and all variations which become evidence as a result of the teaching provided herein. Those of skill in the art will readily recognize a variety of non-critical parameters that could be changed or modified to yield essentially similar results.

Example 1: GYS1 siRNA Sequence ID and Characterization siRNA In Silico Screening: In silico siRNA screening was performed to identify a human siRNA complementary to the human GYS1 mRNA, see FIG. 1. All possible 19-mer antisense sequences were generated from the human GYS1 siRNA sequence (NM_001161587) and each 19-mer was assessed for activity against other human GYS1 isoforms as well as potential cross-reactivity mouse, rat, and Cynomolgus macaque. Human siRNA target sites were assessed for common human SNPs (MAF>1%) using dbSNP (b155 v2). Sequences that targeted a common allele were discarded. Next, siRNA off-target genes were assessed for sense and antisense strands in all relevant model organisms. This selection yielded 200 potential candidates, that were further defined by and in vitro knockdown screen. Lead siRNA candidates are in Table 1A and 1B. GYS1 siRNA linkers for conjugation to cysteine engineered Centyrins were prepared as described in Table 3.

HEK293T cells were lipofected with 10 nM ABXO-HHH (siRNA Pair HHH) for 24 hours alongside untreated control cells (6 replicates per treatment group). mRNA was polyA+ selected from cells and subjected to unstranded 2×150 bp paired end sequencing on the Illumina HiSeq platform to an average depth of >30 million reads.

Figure 2:
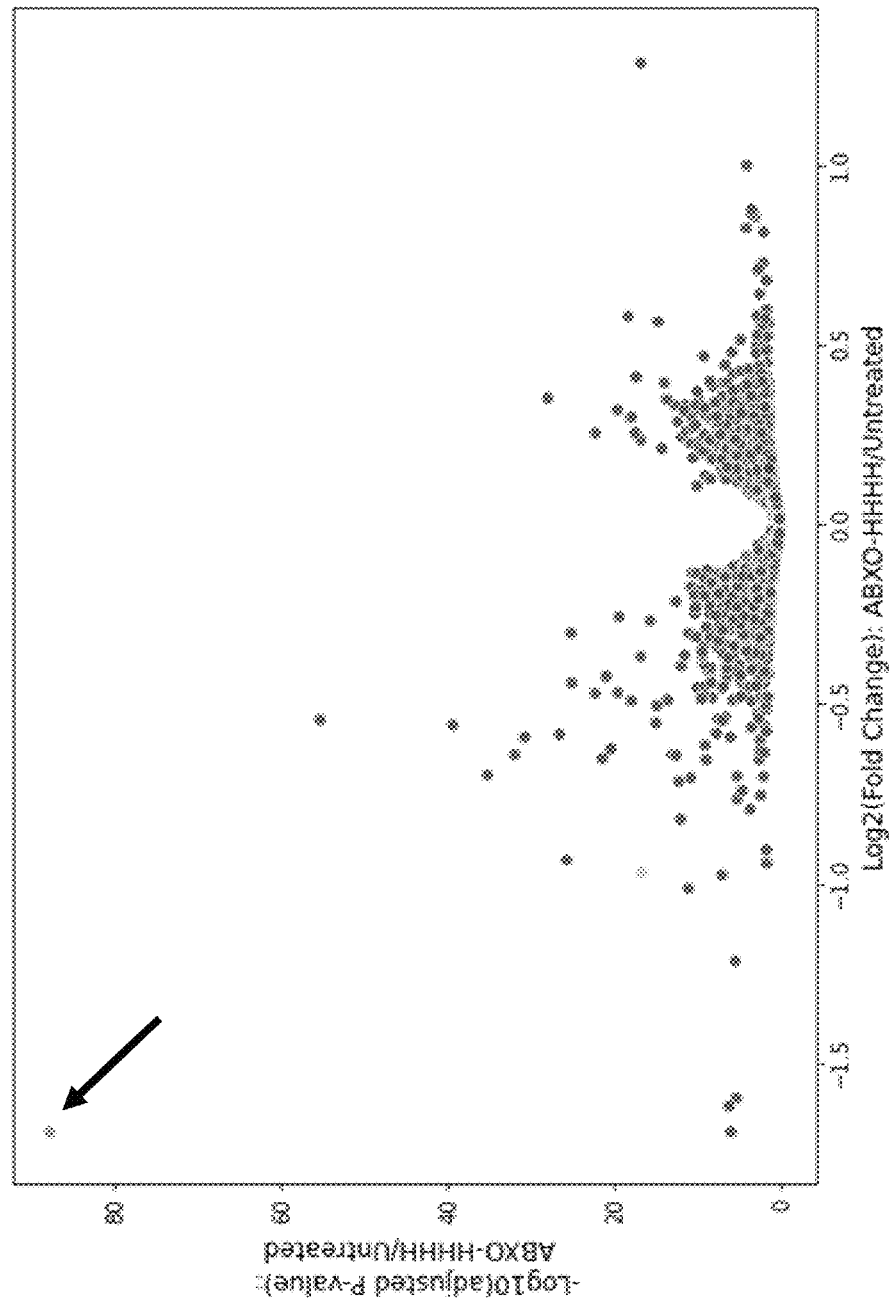
FIG. 2 is a graph of an RNA sequencing experiment which identifies the changes in the transcriptome after cells are transfected with siRNA pair HHH, wherein the arrow identifies the significant decrease in GYS1 transcript.

FIG. 2 Volcano plot showing the DESeq2 results of ABXO-HHH versus untreated cells. The X axis represents the log$_2$ fold change in gene expression (ABXO-HHH divided by untreated) for all genes. The Y axis shows the negative log$_{10}$ transformed adjusted P value. Colored dots represent genes with significant complementarity to ABXO-HHH detected via BLAST.

RNA-seq library quality was inspected using FastQC. Libraries were pseudo aligned to the GrCH38 human transcriptome using Kallisto. We achieved exceptional read alignment with an average of >90% of reads aligning to the transcriptome. Differential expression was then assessed using DESeq2 comparing ABXO-HHH treated cells to lipofectamine only treated cells.

DESeq results showed substantial and significant knockdown of the GYS1 target. GYS1 expression in ABXO-HHH treated samples was downregulated to 31% of untreated samples (FIG. 2). GYS1 was the most downregulated protein coding gene for all genes that were differentially expressed (DE) under ABXO-HHH treatment. GYS1 was also by far the DE gene with the lowest p-value, with an adjusted p-value of 1e-87.7, over 30 orders of magnitude smaller than the next lowest adjusted p-value.

In silico prediction of potential off-target effects was performed using BLAST. The ABXO-HHH sense and antisense sequences were BLAST aligned against an internal BLAST database built from the GRCh38 transcriptome. Of all the potential off-target effects identified by BLAST, only RAP2C was significantly downregulated in the presence of ABXO-HHH (FIG. 2) and failed to surpass the DE threshold of log$_2$ f fold change<−1.

Together these data demonstrate that ABXO-HHH is a highly specific siRNA even at relatively high concentrations in the human transcriptome.

Oligonucleotide synthesis, deprotection and annealing protocol:

Synthesis of oligonucleotides was performed on Mermade 12 synthesizer using standard phosphoramidite chemistry on 500 Å controlled pore glass (CPG) with phosphoramidites at a 0.1 M concentration in acetonitrile. 12 in THF/pyridine/water (0.02M) was the oxidizing agent with 0.6 M ETT (5-ethylthiotetrazole) as the activation agent. N,N-dimethyl-N'-(3-thioxo-3H-1,2,4-dithiazol-5-yl)methanimidamide (DDTT), 0.09 M in pyridine, was used as the sulfurizing reagent for the introduction of phosphorothioate (PS) bonds. 3% (v/v) dichloroacetic acid in dichloromethane was used the deblocking solution. All single strands without maleimide were purified by ion exchange chromatography (IEX) with 20 mM phosphate at pH 8.5 as Buffer A and 20 mM phosphate pH 8.5 and 1 M sodium bromide as Buffer B. After purification, the oligonucleotide fractions were pooled, concentrated, and desalted. Desalted samples were then lyophilized to dryness and stored at −20° C.

Deprotection of Antisense Strands

After synthesis, the support was washed with acetonitrile (ACN) and dried in the column under vacuum and transferred into a 1 mL screw cap that could be tightly sealed and shaken with a solution of 5% diethylamine in aqueous ammonia at 65° C. for 5 h. Cleavage and deprotection of crude oligo was checked by liquid chromatography-mass spectrometry (LC-MS) and was subsequently purified by IEX-HPLC.

Synthesis and Deprotection of Maleimide-Containing Oligonucleotides

Maleimide containing oligos were made using either a 3' amino-modified CPG solid support or a 5' amino modifier phosphoramidite. The support was transferred into a 1 mL vial that could be tightly sealed and incubated with 50/50 v/v 40% aqueous methyl amine and aqueous ammonia (AMA) at room temperature for 2 h or 65° C. for 10 minutes to cleave and deprotect. The single strand was purified by IEX chromatography and desalted the same conditions as the antisense before maleimide addition.

Approximately 20 mg/mL of the amine-modified sense strand in 0.05 M phosphate buffer at pH 7.1 was made to which 10 equivalents of the maleimide N-hydroxysuccinimide (NETS) ester, dissolved in ACN was added. The NETS ester solution was added to the aqueous oligonucleotide solution and shaken for 3 h at room temperature. The now maleimide conjugated oligonucleotides were purified by reverse-phase chromatography (20 mM triethyl ammonium acetate with 80% acetonitrile in Buffer B) to prevent the maleimide hydrolysis under ion exchange buffer conditions.

After purification, the oligonucleotide fractions were pooled, concentrated, and desalted.

To avoid hydrolysis of maleimide, duplexing of the sense and antisense strands was performed via freeze-drying using equimolar amounts of each desalted single strand.

Centyrin conjugation to siRNA, conjugate purification and analysis: Centyrins were conjugated to siRNA through cysteine-specific chemistry via maleimide. Cysteine-containing Centyrin in PBS at 50-200 μM were reduced with 10 mM tris(2-carboxyethyl) phosphine (TCEP) at room temperature (30 mins) to yield a free thiol. The free thiol containing Centyrin is then mixed with maleimide containing siRNA duplex in water immediately prior at a molar ratio of ~1.5:1 Centyrin:siRNA. After 2 hr incubation at RT or 37° C., reaction was quenched with N-ethyl maleimide (1 mM final NEM concentration in the reaction mixture) The conjugate was purified in two steps. Step I either immobilized metal affinity chromatography (for tagged proteins) or Hydrophobic interaction chromatography (for tagless proteins); to remove un-reacted SiRNA linker. Step II-CaptoDEAE; to remove un-reacted centyrin. Fractions containing conjugate were pooled, exchanged into HBS by desalting using dialysis, and concentrated if necessary.

Analytical Characterization of Centyrin-siRNA conjugates: Centyrin -siRNA conjugates were characterized by a combination of analytical techniques. SDS-PAGE was used to compare amounts of conjugate to free protein. For SDS-PAGE, 4-20% Mini-PROTEAN® TGX Stain-Free™ Protein Gels (BioRad) were run in SDS buffer for one hour at 100 V. Gels were visualized under UV light. Analytical SEC (Superdex-75 5/150 GL column-GE) was used to analyze purity and aggregation state of Centyrin-siRNA conjugates. Liquid chromatography/mass spectrometry (LCMS) was used to confirm identity and purity of the conjugates. Samples were analyzed using a Waters Acuity UPLC/Xevo G2-XS TOF mass spectrometer system. The instrument was operated in negative electro-spray ionization mode and scanned from m/z 200 to 3000. Conjugate was seen as two fragments; Antisense and Sense-Centyrin.

Centyrin conjugation to siRNA, conjugate purification and analysis: Centyrins were conjugated to siRNA through cysteine-specific chemistry via maleimide. Cysteine-containing Centyrin in PBS at 50-200 μM were reduced with 10 mM tris(2-carboxyethyl) phosphine (TCEP) at room temperature (30 mins) to yield a free thiol. The free thiol containing Centyrin is then mixed with maleimide containing siRNA duplex in water immediately prior at a molar ratio of ~1.5:1 Centyrin:siRNA. After 2 hr incubation at RT or 37° C., reaction was quenched with N-ethyl maleimide (1 mM final NEM concentration in the reaction mixture) The conjugate was purified in two steps. Step I either immobilized metal affinity chromatography (for tagged proteins) or Hydrophobic interaction chromatography (for tagless proteins); to remove un-reacted SiRNA linker. Step II-Capto-DEAE; to remove un-reacted centyrin. Fractions containing conjugate were pooled, exchanged into HBS by desalting using dialysis, and concentrated if necessary.

Figure 6:
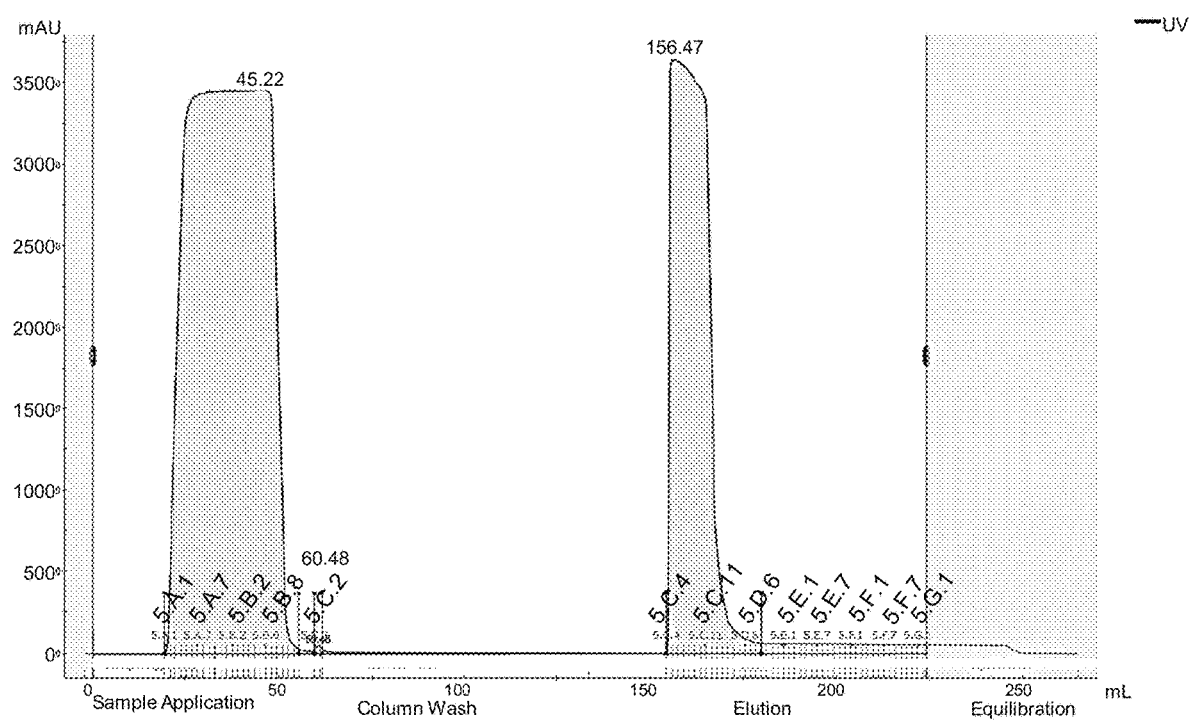
FIG. 6 is an example of Histrap chromatogram for purification of conjugates (Tagged proteins).

FIG. 6: IMAC chromatography for Tagged protein. For IMAC, Histrap HP Columns (1 ml, 5 ml) from Cytiva were used. Histrap Buffer A (Binding Buffer) was 50 mM Tris pH7.4, 500 mM NaCl and 10 mM imidazole in Type 1 H2O, Histrap Buffer B (Elution Buffer): 50 mM Tris pH7.4, 500 mM NaCl and 250 mM imidazole in Type 1 H2O. Reaction sample was directly injected onto the column through sample loop or sample pump. Followed by sample application, column is washed with 5-10 CV of Buffer A. Elution is typically started with step gradient (0-100%). Fractions were collected when UV reading is 50 mAU and above using fraction collector and peak fragmentation.

Figure 7:
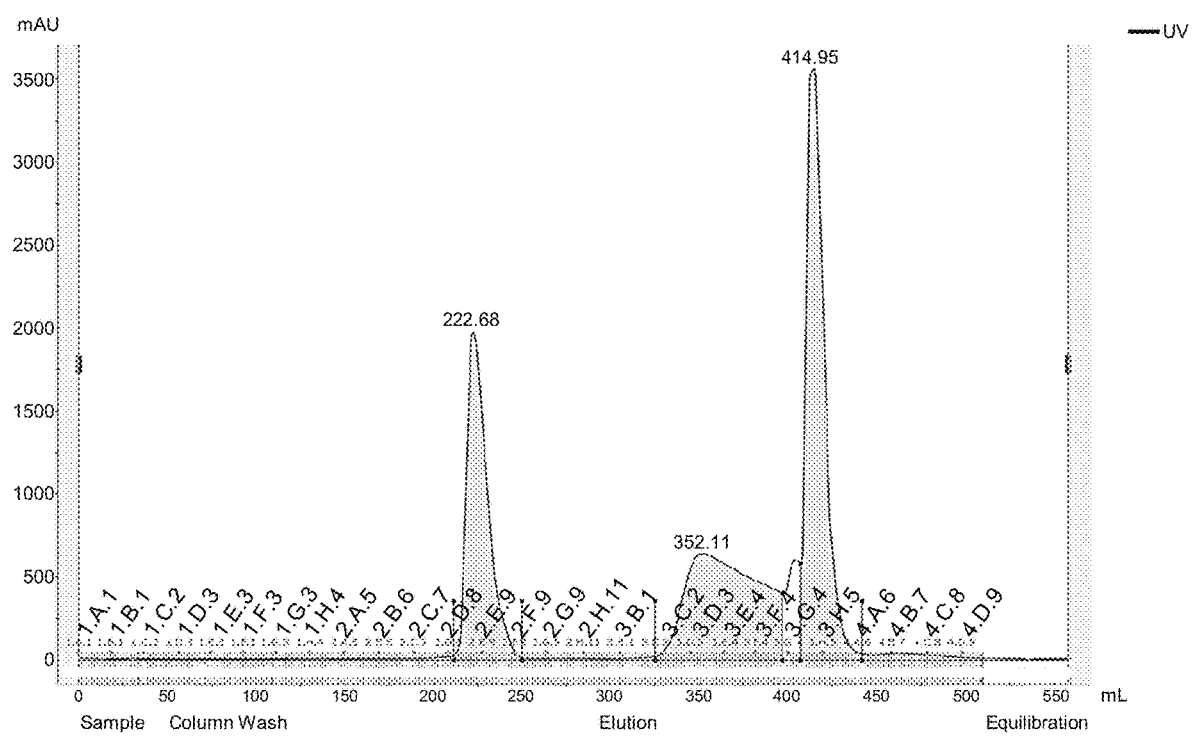
FIG. 7 is an example of HIC chromatogram for purification of conjugate (tagless proteins).

FIG. 7: HIC-for tagless proteins (removal of excess of siRNA). For HIC, HiTrap Butyl HP Columns (1 ml, 5 ml) from Cytiva were used. HIC Buffer A (Binding Buffer) was 2M Ammonium Sulfate, 25 mM Sodium Phosphate pH 7.0 in Type 1 H2O, while, HIC Buffer B (Elution Buffer): 25 mM Sodium Phosphate pH 7.0 in Type 1 H2O. Conjugation reaction sample is diluted with Buffer A in ratio of 1:1. Sample prepared above was injected onto the column through sample loop or sample pump. Followed by sample application, column is washed with 5 CV of Buffer A. Elution is typically started with 0.0% B and then a gradient as Table 10 below. Fractions collected when UV reading is 50 mAU and above using fraction collector and peak fragmentation.

TABLE 10

| | Type | % B | Length (CV) |
|---|---|---|---|
| 1 | Linear | 30 to 90 | 3.00 |
| 2 | Linear | 35.0 | 10.00 |
| 3 | Linear | 100.0 | 10.00 |
| 4 | Linear | 100.0 | 5.00 |

Ring-opening-To avoid loss of cargo via retro-Michael reaction, maleimide ring hydrolysis is performed. Pooled fractions from either histrap (tagged protein) or from HIC (tagless protein) is dialyzed into 25 mM TRIS pH 8.9 buffer. In this buffer the reaction is placed in an incubator shaker at 37 degrees C. for 72 hrs. Reaction monitored for completion by LC-MS.

Figure 8:
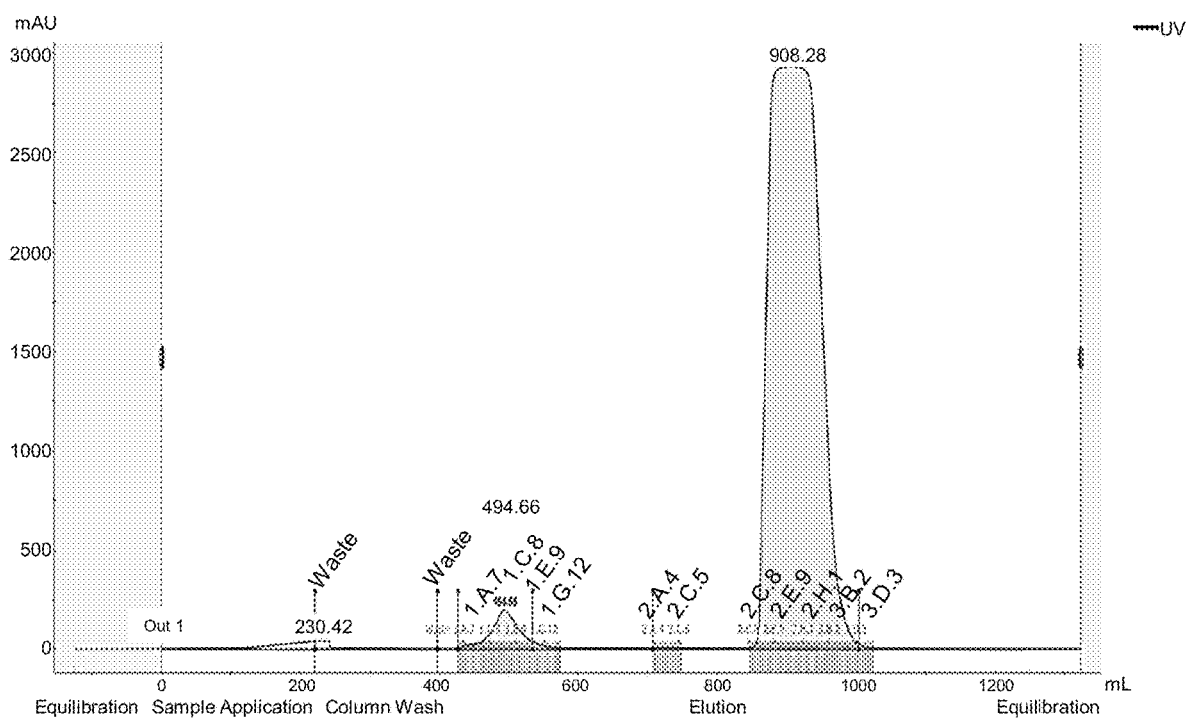
FIG. 8 is an example of Ion-exchange chromatogram for purification of conjugate (Tagged/tagless protein).

FIG. 8: Ion-exchange chromatography (IEX)-for tagged and tagless proteins (removal of excess unreacted centyrin). For IEX chromatography, HiTrap Capto DEAE Columns (1 ml, 5 ml) from Cytiva were used. Capto DEAE Buffer A (Binding Buffer) was 25 mM Tris pH 8.8 in Type 1 H2O, while, Capto DEAE Buffer B (Elution Buffer) used was 25 mM Tris pH 8.8, 1M NaCl in Type 1 H2O.

Sample after ring opening was directly injected onto the column through sample loop or sample pump. Followed by sample application, column is washed with 5-10 CV of Buffer A. Elution is typically started with 0.0% B and then a gradient as Table 11 below.

Unreacted protein is eluted in the flowthrough which is typically the first peak and second peak is typically pure conjugate. All the fractions are collected and pooled. Concentration of the pool is determined by measuring A260 using Nanodrop for yield calculation.

TABLE 11

| 1 | Linear | 20 | 5 |
| 2 | Linear | 100 | 15 |
| 3 | Linear | 100 | 5 |

Figure 9:
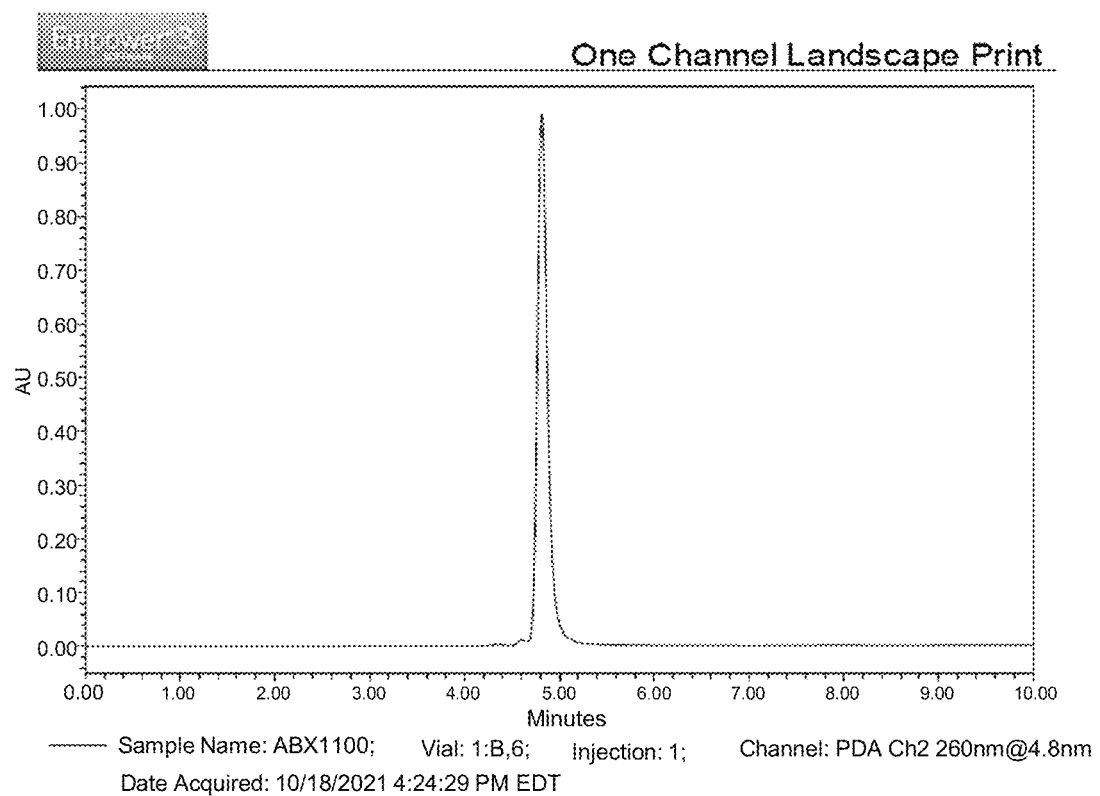
FIG. 9 is an example of an analytical SEC of the centyrin-oligonucleotide conjugate.

FIG. 9: Example of an analytical SEC of the centyrin-oligonucleotide conjugate. Centyrin-siRNA conjugates were characterized by a combination of analytical techniques. Analytical SEC was used to analyze purity and aggregation state of Centyrin-siRNA conjugates. Waters H-class UPLC along with Waters ACQUITY UPLC Protein BEH SEC Column, 125 Å, 1.7 µm, 4.6×150 mm was used for routine SEC analysis. Typically, 2-5 ul sample was injected using the autosampler, flow rate was 0.25 ml/min and mobile phase used was either 1X PBS or 100 mM, pH 7.2 phosphate buffer.

Figure 10:
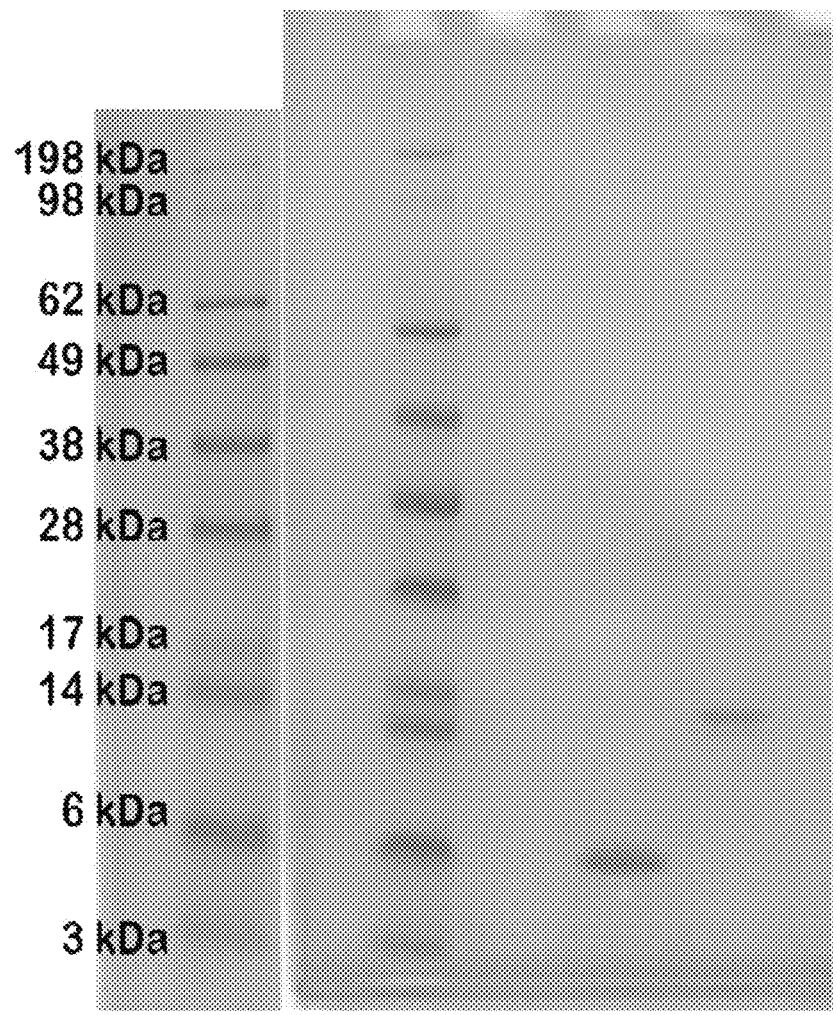
FIG. 10 is an example of SDS PAGE Gel of the conjugate.

FIG. 10: Example of SDS PAGE Gel of the conjugate. SDS-PAGE was used to compare amounts of conjugate to free protein. For performing the SDS-PAGE Gel; Invitrogen Mini Gel tank. PowerEase™ Touch 600W Power Supply and 115 VAC was used. Invitrogen -NuPAGE™ 4-12% Bis-Tris Protein Gels, 1.0 mm were used along with 20×Nu-PAGE® MES SDS Running Buffer and SeeBlue™ Pre-stained Protein Standard. Samples normalized to around 0.5 mg/mL by ultrapure water. For non-reducing gel, 10 µL of normalized samples are mixed with 10 µL of 2×Laemmli Sample Buffer in 1 to 1 ratio. For reducing gel, 2×Laemmli Sample Buffer is mixed with β-Mercaptoethanol in 95 to 1 ratio and then mixed with 10 µL of samples in 1 to 1 ratio. The resulting sample mixtures were boiled at 95° C. for 5 minutes and then cool down in the Thermocycler. 15 µL of samples and Protein Ladder into appropriate wells were loaded, the voltage was set at 200V and run time was set for around 30 minutes. Once the gel run was finished, it was visualized by Coomassie blue or SYBR Green or methylene blue. Left most lane is Protein Ladder, next is Centyrin by itself and last is the centyrin-siRNA conjugate.

Candidate siRNA sequences were transfected into human cells (H358) at a range of concentrations. RNA was harvested 24 hours post-transfection and analyzed for GYS1 levels via quantitative reverse transcription polymerase chain reaction (RT-PCR). 18S ribosomal RNA was used as the RT-PCR endogenous control gene. Levels of knockdown were compared to untreated cells. EC50 values were calculated using Graphpad Prism software and Emax values represent the maximum percent knockdown of GYS1 mRNA observed (Table 5).

TABLE 5

| siRNA | Ref. | EC50 (pM) | Emax (%) |
|---|---|---|---|
| A | ABXO8 | 3.841 | 70 |
| B | ABXO9 | 10.02 | 70.2 |
| C | ABXO12 | 12.62 | 71.5 |
| D | ABXO110 | 21.73 | 87.9 |
| E | ABXO113 | 23.74 | 82.1 |
| F | ABXO114 | 6.716 | 75.5 |
| G | ABXO115 | 4.5 | 75.2 |
| H | ABXO116 | 0.7542 | 69.4 |
| I | ABXO117 | 20.87 | 93.8 |
| J | ABXO122 | 8.93 | 65.6 |
| K | ABXO123 | 4.049 | 75.5 |
| L | ABXO124 | 2.642 | 70.5 |
| M | ABXO125 | 0.8761 | 53.3 |
| N | ABXO128 | 2.549 | 76.3 |
| O | ABXO129 | 0.4961 | 64.3 |
| P | ABXO139 | 0.6143 | 70.6 |

TABLE 5-continued

| siRNA | Ref. | EC50 (pM) | Emax (%) |
|---|---|---|---|
| Q | ABXO142 | 23.19 | 80.3 |
| R | ABXO150 | 58.88 | 96.1 |
| S | ABXO151 | 1.502 | 75.6 |
| T | ABXO152 | 24.76 | 91.1 |
| U | ABXO155 | 5.893 | 60.2 |
| V | ABXO156 | 0.6893 | 57.6 |
| W | ABXO160 | 0.787 | 80.1 |
| X | ABXO168 | 8.662 | 75.7 |
| Y | ABXO171 | 38.82 | 69.2 |
| Z | ABXO191 | 54.2 | 75.4 |
| AA | ABXO197 | 19.8 | 77.1 |
| BB | ABXO201 | 7.1 | 75.6 |
| CC | ABXO203 | 5.7 | 74.9 |
| DD | ABXO205 | 9.8 | 80.4 |

Other siRNAs have also been tested as described above and their EC50 are provided in Table 6.

TABLE 6

| siRNA Pair | EC50 (pM) |
|---|---|
| EE | 1.8 |
| FF | 6 |
| GG | 5.9 |
| HH | 15.1 |
| II | 8.2 |
| JJ | 25.2 |
| KK | |
| LL | 1.35 |
| MM | 3.74 |
| NN | 5.66 |
| OO | 5.56 |
| PP | 6.34 |
| QQ | 11.76 |
| RR | 2.85 |
| SS | 3.35 |
| TT | 5.67 |
| UU | 0.4 |
| VV | 3.72 |
| WW | 3.15 |
| XX | 2.57 |
| YY | 1.64 |
| ZZ | 1.56 |
| AAA | ND |
| BBB | 4.87 |
| CCC | 2.65 |
| DDD | 2.66 |
| EEE | 1.21 |
| FFF | 1.31 |
| GGG | NA |

Selectivity of candidate siRNA sequences was evaluated by transfection of siRNAs into human cells (HEK-293) at a range of concentrations. Cell viability was assessed 72 hours post-transfection using CellTiterGlo. Emax values are reported as the maximum percent reduction in cell viability at the highest siRNA concentration tested (10 nM) (Table 7).

TABLE 7

| siRNA Pair | Ref. | Emax, % (at 10 nM) |
|---|---|---|
| A | ABXO8 | 5.52 |
| B | ABXO9 | −0.3 |
| C | ABXO12 | 31.67 |
| D | ABXO110 | 25.68 |
| E | ABXO113 | 22.83 |
| F | ABXO114 | −1.1 |
| G | ABXO115 | 30.85 |
| H | ABXO116 | 29.27 |
| I | ABXO117 | 35.19 |

TABLE 7-continued

| siRNA Pair | Ref. | Emax, % (at 10 nM) |
|---|---|---|
| J | ABXO122 | 28.25 |
| K | ABXO123 | 17.21 |
| L | ABXO124 | 24.09 |
| M | ABXO125 | 71.45 |
| N | ABXO128 | 42.41 |
| O | ABXO129 | 58.02 |
| P | ABXO139 | 34.44 |
| Q | ABXO142 | 8.94 |
| R | ABXO150 | 16.06 |
| S | ABXO151 | 60.95 |
| T | ABXO152 | 42.84 |
| U | ABXO155 | 54.4 |
| V | ABXO156 | 34.1 |
| W | ABXO160 | −4.59 |
| X | ABXO168 | 51.66 |
| Y | ABXO171 | 4.79 |
| Z | ABXO191 | 46.41 |
| AA | ABXO197 | 25.01 |
| BB | ABXO201 | 46.92 |
| CC | ABXO203 | 15.18 |
| DD | ABXO205 | 60.13 |

Example 2: Selection of Fibronectin Type III (FN3) Domains that Bind CD71

Panning and Biochemical Screening Methods for Identifying FN3 domains that bind to CD71 that do not inhibit transferrin binding to CD71. To screen for FN3 domains that specifically bind CD71 and do not inhibit transferring binding to CD71, streptavidin-coated Maxisorp plates (Nunc catalog 436110) are blocked for 1 hour in Starting Block T20 (Pierce) and then are coated with biotinylated CD71 (using same antigen as in panning) or negative controls (an unrelated Fc-fused recombinant protein and human serum albumin) for 1 hour in the presence of transferring or with FN3 protein that binds to the CD71 transferrin binding site. The concentration of transferrin is up to 35 µM. Without being bound to any particular theory, the inclusion of the transferrin or the FN3 protein that binds to the CD71 transferrin binding site pushes the selection of the FN3 domains to those that do not compete or inhibit with transferrin binding to CD71. Plates are rinsed with TBST and diluted lysate is applied to plates for 1 hour. Following additional rinses, wells are treated with HRP-conjugated anti-V5 tag antibody (Abcam, ab1325), for 1 hour and then are assayed with POD (Roche,11582950001). The DNA from FN3 domain lysates with signals at least 10-fold ELISA signal above that of streptavidin controls are sequenced resulting in FN3 domain sequences isolated from the screening.

Example 3: Selection of Fibronectin Type III (FN3) Domains that Bind CD71 and are not Competitive with Transferrin To identify CD71 binding FN3 domains that were either not competitive or minimally competitive with transferrin a biased CIS-display strategy was designed. In short, using the output recovered after 5 rounds of panning on the ECD of human CD71 (Example 3). Additional rounds of off-rate selection were performed as described in Example 3 with the addition of either 1) a wash step with human holo transferrin to elute Centyrins that bound at the same site as transferrin before the final elution step or 2) elution of FN3 domain binders with monoclonal antibody OKT9. FN3 domains recovered from the transferrin wash strategy and the OKT9 elution strategy were PCR amplified and cloned into pET vector as previously described. 228 FN3 domains that specifically bound huCD71 were confirmed by ELISA for binding to huCD71 ECD. A subset of the unique binders was analyzed by SEC, conjugated to MMAF and assessed for internalization via cell viability assay in SKBR-3 cells+/− holo human transferrin. The polypeptides were found to be internalized by the receptor.

Integral Molecular performed Membrane Proteome Array (MPA) assay to profile the specificity of ABX1198 (SEQ ID NO: 509) and ABX1100 (SEQ ID NO: 509 plus siRNA pair with linker number 0000) against the library of human membrane proteins. The MPA library contains over 6000 human membrane proteins, including 94% of all single-pass, multi-pass and GPI anchored proteins including GPCRs, ion channels and transporters with each membrane protein uniquely expressed in an avian QT6 cell background. Flow cytometry is used to directly detect ligand (FN3 domain) binding to membrane proteins individually expressed in unfixed cells.

ABX1198 (SEQ ID NO: 509) and ABX1100 (SEQ ID NO: 509 plus siRNA pair with linker number 0000) were screened at the concentration with optimal signal/background noise ratio, 1.25 ug/ml, 1.25 ug/ml and 0.31 ug/ml respectively, against the MPA. Membrane protein targets identified in screening were followed up in validation procedure using ligand serial dilution and cells individually transfected with identified targets.

Example 4. Knockdown of mRNA in Muscle Cells Using CD71 FN3 Domain-Oligonucleotide Conjugates muCD71 binding FN3 domains are conjugated to siRNA oligonucleotides or antisense oligonucleotides (ASOs) using maleimide chemistry via a cysteine that is uniquely engineered into the FN3 domain. The cysteine substitutions can be one such as those provided for herein and also as provided for in U.S. Patent Application Publication No. 20150104808, which is hereby incorporated by reference in its entirety. siRNAs or ASOs are modified with standard chemical modifications and confirmed to enable knockdown of the targeted mRNA in vitro. FN3 domain-oligonucleotide conjugates are dosed intravenously in mice at doses up to 10 mg/kg oligonucleotide payload. At various time points following dosing, mice are sacrificed; skeletal muscle, heart muscle and various other tissues will be recovered and stored in RNAlater™ (Sigma Aldrich) until needed. Target gene knockdown is assessed using standard qPCR $\Delta\Delta C_T$ methods and primers specific for the target gene and a control gene. The target gene is found to be knock downed in the muscles and such knockdown is enhanced by conjugating the siRNA or ASO to the CD71 FN3 binding domain.

FN3-siRNA conjugates tested are as described in table 8

TABLE 8

| Conjugate | CD71 FN3 domain (Centyrin) | GYS1 siRNA Pair |
|---|---|---|
| ABXC-1 | SEQ ID NO: 572 | RRRR |
| ABXC-2 | SEQ ID NO: 572 | SSSS |
| ABXC-3 | SEQ ID NO: 572 | TTTT |
| ABX1005 | SEQ ID NO: 572 | Non-GYS1 target/control |
| ABXC-27 | SEQ ID NO: 572 | A |
| ABXC-28 | SEQ ID NO: 572 | QQQQ |
| ABXC-29 | SEQ ID NO: 572 | pppp |

Figure 4A:
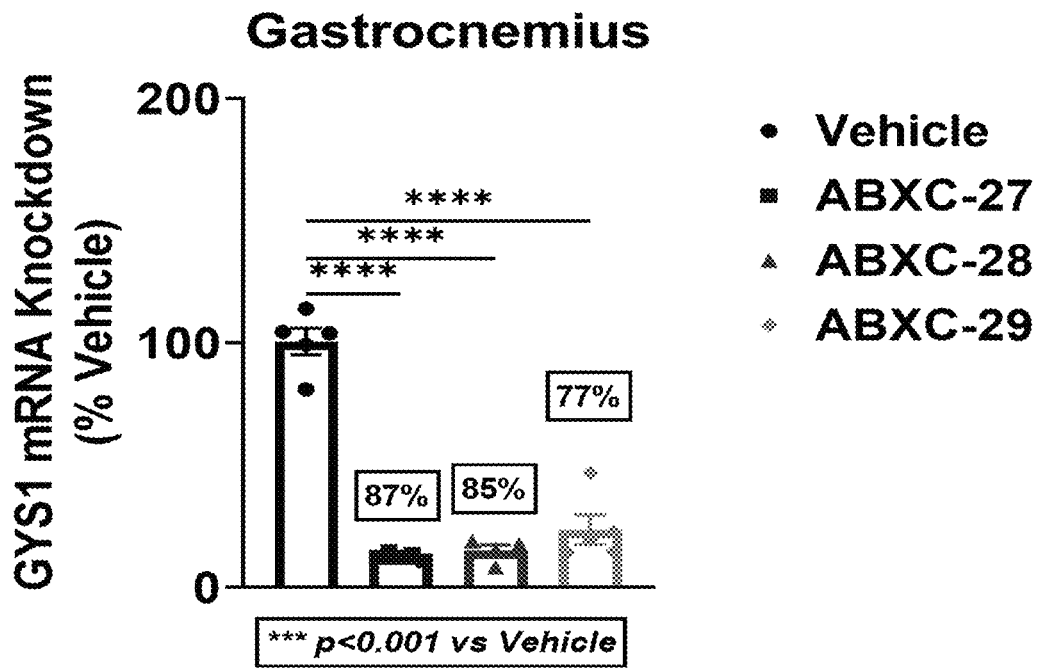
FIG. 4A demonstrates the knockdown of GYS1 mRNA in mouse gastrocnemius muscle using 3 difference FN3 domain-siRNA conjugates compared with vehicle alone.

FIG. 4A demonstrates the knockdown of GYS1 mRNA in mouse gastrocnemius muscle using 3 different FN3 domain-siRNA conjugates compared with vehicle alone. For efficacy studies, male GAA−/− mice (at the ages of 4-5 weeks) were obtained from Jackson Laboratories. All animals were treated in accordance with IACUC protocols. Five animals received a single tail vein intravenous bolus injection of either 5.4 mg/kg of three different FN3 domain-siRNA conjugates (3 mpk Gys1 siRNA) or vehicle. Four weeks after the single dose, the mice were euthanized, gastrocnemius muscle were collected in RNAlater, stored at 4C overnight and were frozen at −80C. Total RNA was isolated from the gastrocnemius using Qiagen's RNeasy Fibrous Tissue kit. Expression levels of the target Gys1 and the endogenous controls (Pgk1, Ubc, Hprt1 and Aha1) were analyzed using real-time, quantitative PCR. Data were analyzed using the $\Delta\Delta Ct$ method normalizing to control animals dosed with vehicle alone. The percentage knockdown of Gys1 mRNA in the FN3 domain-siRNA conjugate treatment groups were measured by subtracting the percentage remaining Gys1 mRNA levels by 100. Statistical significance was calculated using One-way ANOVA with Dunnett's multiple comparison tests in the GraphPad Prism software. Statistical significance is displayed on the figure with asterisk ***$p<0.001$.

Figure 4B:
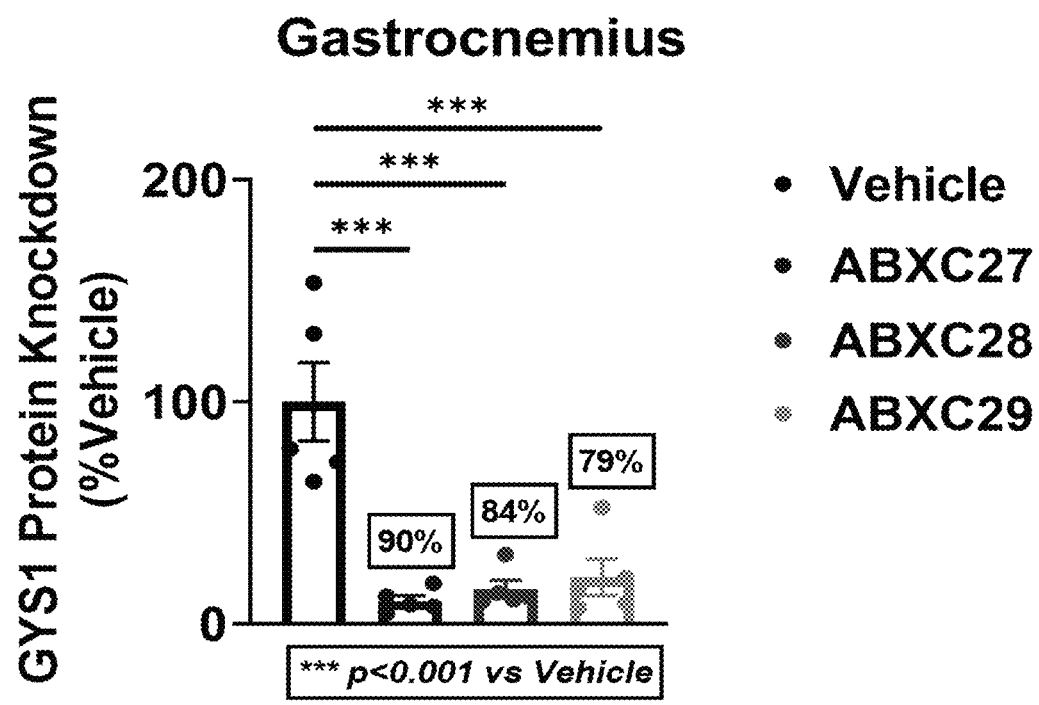
FIG. 4B demonstrates the knockdown of GYS1 protein in mouse gastrocnemius muscle using 3 difference FN3 domain-siRNA conjugates compared with vehicle alone.

FIG. 4B demonstrates the knockdown of GYS1 protein in mouse gastrocnemius muscle using 3 different FN3 domain-siRNA conjugates compared with vehicle alone. Gys1 protein quantification in gastrocnemius was performed by homogenizing gastrocnemius in RIPA buffer. Protein concentrations in the gastrocnemius were measured using the Bradford assay. Gys1 levels were quantified using the manufacturer's standard method for 12-230 kDa Jess separation modules (SM-W004). The proteins were separated by immobilizing on capillaries using protein Simple's proprietary photoactivated capture chemistry. Anti-Gys1 primary antibody were used at 1:100 dilution. The chemiluminescent revelations were established using peroxide/luminol-S. A digital image of the capillaries' chemiluminescence was captured using Compass' Simple Western software, which automatically measures height (chemiluminescence intensity), area, and signal/noise ratio. An internal system was included in each run. The peak area values of FN3 domain-siRNA conjugate treatment groups were normalized to the vehicle treated tissues and the percentage knockdown of Gys1 protein in the treatment groups were measured by subtracting the percentage remaining Gys1 protein levels by 100. Statistical significance was calculated using One-way ANOVA with Dunnett's multiple comparison tests in the GraphPad Prism software. Statistical significance is displayed on the figure with asterisk ***$p<0.001$.

Figure 5:
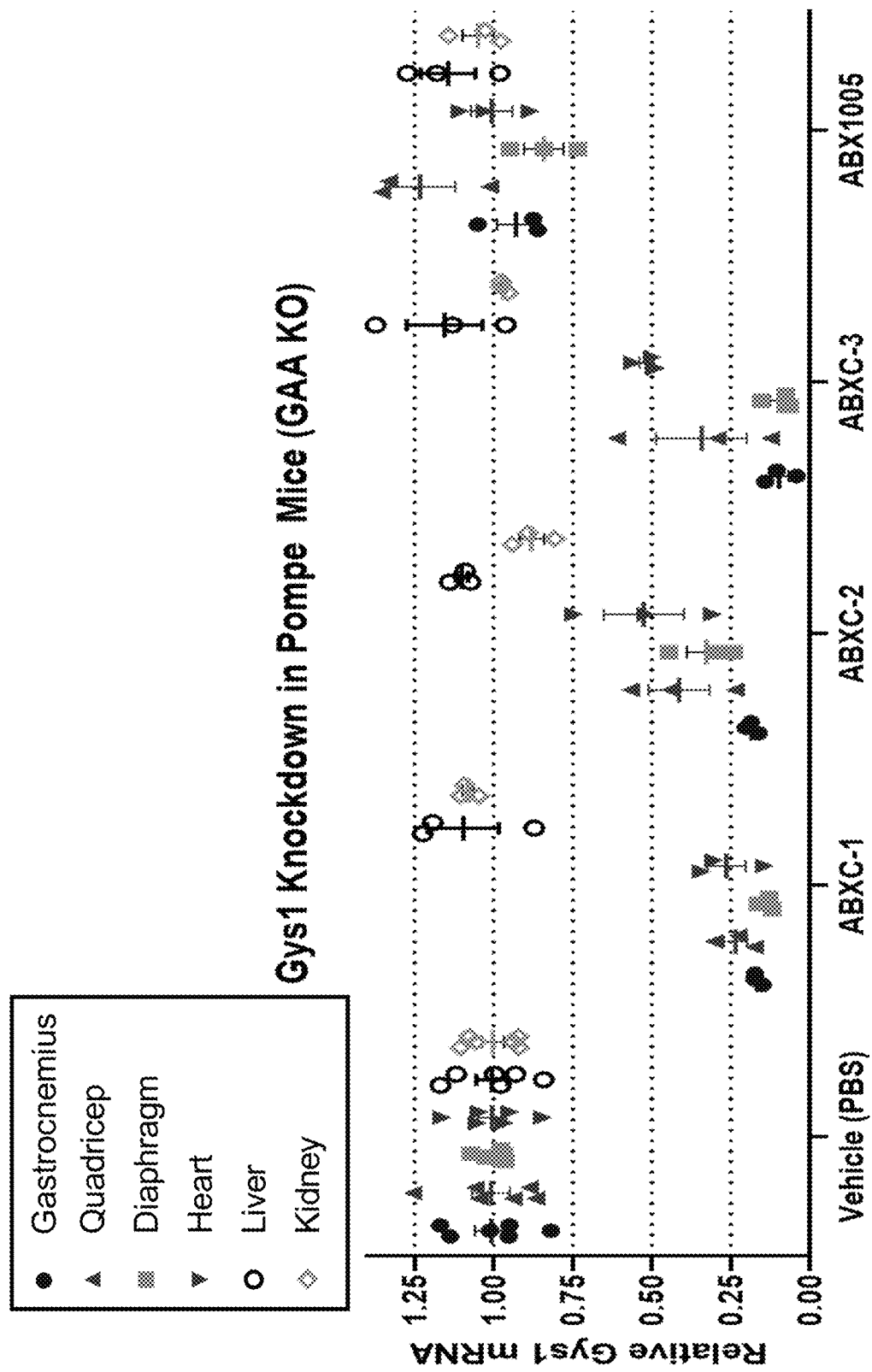
FIG. 5 demonstrates the GYS1 knockdown is highly specific for skeletal muscle using 3 different FN3 domain-siRNA conjugates compared with a siRNA to a different target (AHA-1).

FIG. 5 demonstrates the GYS1 knockdown is highly specific for skeletal muscle using 3 different FN3 domain-siRNA conjugates compared with a siRNA to a different target (AHA-1). Male GAA−/− mice (at the ages of 8-9 weeks) were obtained from Jackson Laboratories. All animals were treated in accordance with IACUC protocols. Three animals received a single tail vein intravenous bolus injection of either 17.9 mg/kg of three different FN3 domain-siRNA conjugates (10 mpk Gys1 siRNA), 17.9 mg/kg of one FN3 domain-siRNA conjugate (10 mpk Aha1 siRNA) or vehicle. Two weeks after the single dose, the mice were euthanized. Gastrocnemius, quadriceps, diaphragm, heart, liver, and kidney tissues were collected in RNAlater, stored at 4C overnight and were frozen at −80C. Total RNA was isolated from the tissues using Qiagen's RNeasy Fibrous Tissue kit. Expression levels of the target Gys1/Aha1 and the endogenous control (Pgk1) were analyzed using real-time, quantitative PCR. Data were analyzed using the ΔΔCt method normalizing to control animals dosed with vehicle alone.

Example 5: RNA-Seq Experiments Comparing ABX-HHH Treated and Untreated Cells mRNA sequencing was performed on polyA+ selected mRNA after HEK293T cells were lipofected with 10 nM ABXO-HHH for 24 h. 6 replicates per treatment were sequenced to an average depth >30 million reads. Libraries were pseudoaligned to the GRCh38 transcriptome using Kallisto with a mapping rate >90%. The values in this volcano plot were generated using DESeq2 to compare ABXO-HHH treated RNA-seq libraries versus untreated cells. Each dot in the plot in FIG. 2 represents the measured expression change in a gene. The X axis represents the $\log_2$ fold change in gene expression (ABXO-HHH divided by untreated) for all genes. The Y axis shows the negative $\log_{in}$ transformed adjusted P value. The black arrow points to GYS1 on the plot.

Example 6: CD71 FN3 Domain siRNA Conjugate Binding Specificity

Figure 3:
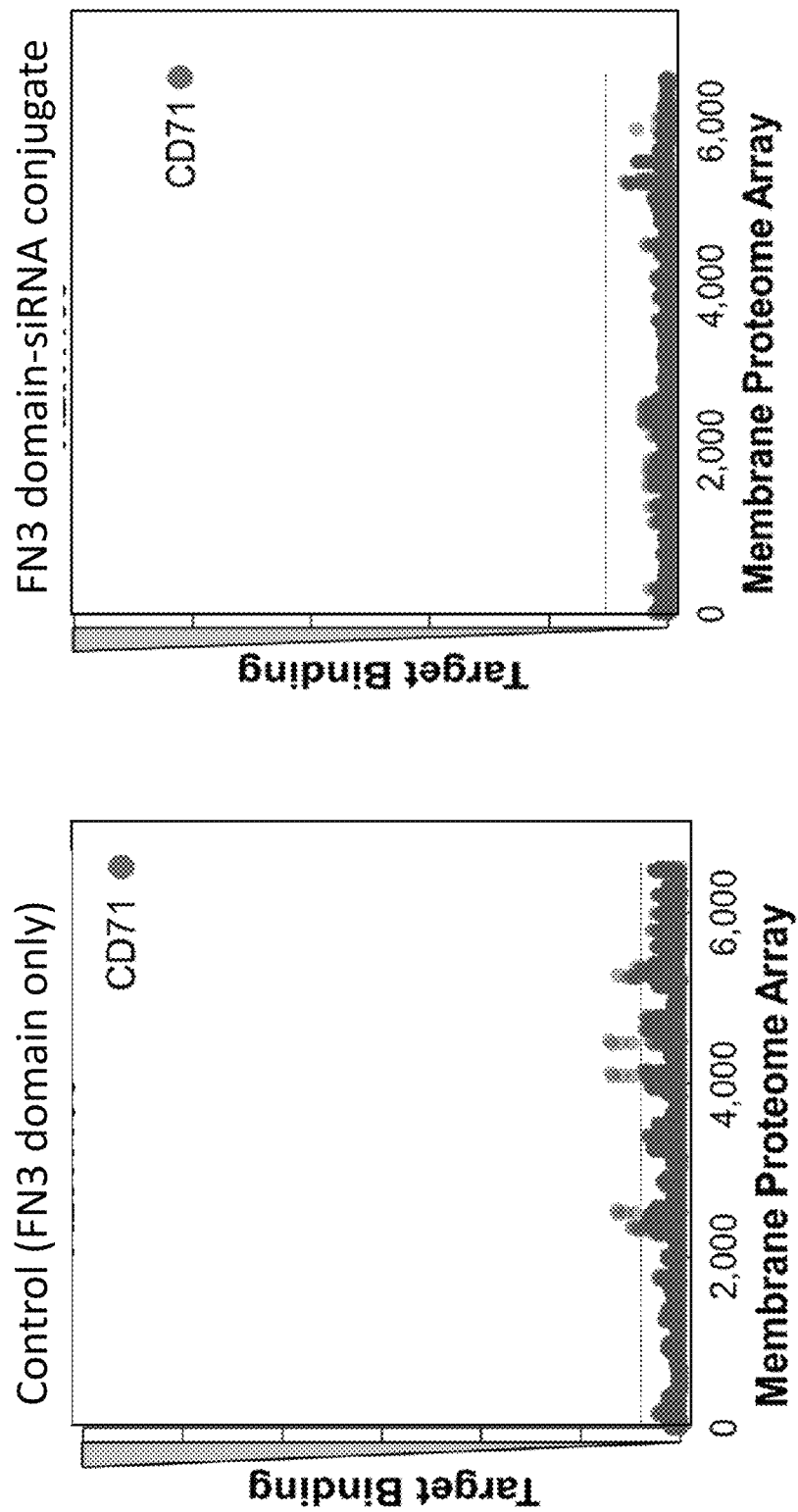
FIG. 3 provides the results of a target binding assay using over 6,000 receptors in the proteome array, wherein the data demonstrates that CD71 is the exclusive binding target of the FN3 domain.

Integral Molecular (www.integralmolecular.com) performed their proprietary Membrane Proteome Array (MPA) assay to profile the specificity of CD71 FN3 domain and CD71 FN3 domain siRNA conjugate against the library of human membrane proteins (FIG. 3). The MPA contains over 6000 human membrane proteins, covering 94% of all single-pass, multi-pass and GPI anchored proteins including GPCRs, ion channels and transporters with each membrane protein uniquely expressed in an avian QT6 cell background. Flow cytometry was used to directly detect FN3 domain binding to membrane proteins individually expressed in unfixed cells.

FN3 domain and FN3 domain-siRNA conjugate were screened at the concentration with optimal signal/background noise ratio, 1.25 ug/ml or 0.31 ug/ml respectively, against the MPA. Membrane protein targets identified in screening were validated using ligand serial dilution on cells uniquely expressing the identified targets.

General Methods

Standard methods in molecular biology are described Sambrook, Fritsch and Maniatis (1982 & 1989 2$^{nd}$ Edition, 2001 3$^{rd}$ Edition) *Molecular Cloning, A Laboratory Manual*, Cold Spring Harbor Laboratory Press, Cold Spring Harbor, NY; Sambrook and Russell (2001) *Molecular Cloning*, 3$^{rd}$ ed., Cold Spring Harbor Laboratory Press, Cold Spring Harbor, NY; Wu (1993) *Recombinant DNA*, Vol. 217, Academic Press, San Diego, CA). Standard methods also appear in Ausbel, et al. (2001) *Current Protocols in Molecular Biology*, Vols. 1-4, John Wiley and Sons, Inc. New York, NY, which describes cloning in bacterial cells and DNA mutagenesis (Vol. 1), cloning in mammalian cells and yeast (Vol. 2), glycoconjugates and protein expression (Vol. 3), and bioinformatics (Vol. 4).

Methods for protein purification including immunoprecipitation, chromatography, electrophoresis, centrifugation, and crystallization are described (Coligan, et al. (2000) *Current Protocols in Protein Science*, Vol. 1, John Wiley and Sons, Inc., New York). Chemical analysis, chemical modification, post-translational modification, production of fusion proteins, glycosylation of proteins are described (see, e.g., Coligan, et al. (2000) *Current Protocols in Protein Science*, Vol. 2, John Wiley and Sons, Inc., New York; Ausubel, et al. (2001) *Current Protocols in Molecular Biology*, Vol. 3, John Wiley and Sons, Inc., NY, NY, pp. 16.0.5-16.22.17; Sigma-Aldrich, Co. (2001) *Products for Life Science Research*, St. Louis, MO; pp. 45-89; Amersham Pharmacia Biotech (2001) *BioDirectory, Piscataway, N.J.*, pp. 384-391). Production, purification, and fragmentation of polyclonal and monoclonal antibodies are described (Coligan, et al. (2001) *Current Protcols in Immunology*, Vol. 1, John Wiley and Sons, Inc., New York; Harlow and Lane (1999) *Using Antibodies*, Cold Spring Harbor Laboratory Press, Cold Spring Harbor, NY; Harlow and Lane, supra). Standard techniques for characterizing ligand/receptor interactions are available (see, e.g., Coligan, et al. (2001) *Current Protocols in Immunology*, Vol. 4, John Wiley, Inc., New York).

All references cited herein are incorporated by reference to the same extent as if each individual publication, database entry (e.g. Genbank sequences or GeneID entries), patent application, or patent, was specifically and individually indicated to be incorporated by reference. This statement of incorporation by reference is intended by Applicants, pursuant to 37 C.F.R. § 1.57(b)(1), to relate to each and every individual publication, database entry (e.g. Genbank sequences or GeneID entries), patent application, or patent, each of which is clearly identified in compliance with 37 C.F.R. § 1.57(b)(2), even if such citation is not immediately adjacent to a dedicated statement of incorporation by reference. The inclusion of dedicated statements of incorporation by reference, if any, within the specification does not in any way weaken this general statement of incorporation by reference. Citation of the references herein is not intended as an admission that the reference is pertinent prior art, nor does it constitute any admission as to the contents or date of these publications or documents.

The present embodiments are not to be limited in scope by the specific embodiments described herein. Indeed, various modifications of the embodiments in addition to those described herein will become apparent to those skilled in the art from the foregoing description. Such modifications are intended to fall within the scope of the appended claims.

The foregoing written specification is considered to be sufficient to enable one skilled in the art to practice the embodiments. Various modifications of the embodiments in addition to those shown and described herein will become apparent to those skilled in the art from the foregoing description and fall within the scope of the appended claims.

SEQUENCE LISTING (1075 sequences)

SEQ ID NO: 1 - protein, 89 aa, Artificial Sequence
  Description of Artificial Sequence: Synthetic polypeptide
LPAPKNLVVSEVTEDSLRLSWTAPDAAFDSFLIQYQESEKVGEAINLTVPGSERSYDLTGLKPGTEYTVSIYGVKGGHRSNPLSAEFTT

SEQ ID NO: 2 - protein, 291 aa, Homo sapiens
MTKEYQDLQHLDNEESDHHQLRKGPPPPQPLLQRLCSGPRLLLLSLGLSLLLLVVVCVIGSQNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 3 - skipped

SEQ ID NO: 4 - protein, 89 aa, Artificial Sequence
  Description of Artificial Sequence: Synthetic polypeptide
LPAPKNLVVSRVTEDSARLSWTAPDAAFDSFLIQYQESEKVGEAIVLTVPGSERSYDLTGLKPGTEYTVSIYGVKGGHRSNPLSAIFTT

SEQ ID NO: 5 - protein, 230 aa, Homo sapiens
QNSQLQEELRGLRETFSNFTASTEAQVKGLSTQGGNVGRKMKSLESQLEKQQKDLSEDHSSLLLHVKQFVSDLRSLSCQMAALQGNGSERTCCPVNWVEHERSCYWFSRSGKAWADADNYCRLEDAHLVVVTSWEEQKFVQHHIGPVNTWMGLHDQNGPWKWVDGTDYETGFKNWRPEQPDDWYGHGLGGGEDCAHFTDDGRWNDDVCQRPYRWVCETELDKASQEPPLL

SEQ ID NO: 6-9 - skipped (4 entries)

SEQ ID NO: 10 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaauucgaat

SEQ ID NO: 11 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 12 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
caagguggguggcaucuaat

SEQ ID NO: 13 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 14 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
uccgcagccuggaugauuat

SEQ ID NO: 15 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uaaucauccaggcugcggauu

SEQ ID NO: 16 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gcgacugccuguagcaacat

SEQ ID NO: 17 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uguugcuacaggcagucgcuu

SEQ ID NO: 18 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuuaugggcaucuggacuat

SEQ ID NO: 19 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uaguccagaugcccauaaauu

SEQ ID NO: 20 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gcgcggaccaacaauuucat

SEQ ID NO: 21 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugaaauuguugguccgcgcuu

SEQ ID NO: 22 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ggaccaacaauuucaacgat

SEQ ID NO: 23 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ucguugaaauuguugguccuu

SEQ ID NO: 24 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
accaacaauuucaacgugat

SEQ ID NO: 25 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ucacguugaaauuguugguuu

SEQ ID NO: 26 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gcgcaaacagcuuugggaat

SEQ ID NO: 27 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uucccaaagcuguuugcgcuu

SEQ ID NO: 28 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
agagccaucuuugcaacgat

SEQ ID NO: 29 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ucguugcaaagauggcucuuu

SEQ ID NO: 30 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaacgcat

SEQ ID NO: 31 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 32 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
agccaucuuugcaacgcaat

SEQ ID NO: 33 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uugcguugcaaagauggcuuu

SEQ ID NO: 34 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ccaucuuugcaacgcagcat

SEQ ID NO: 35 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcugcguugcaaagaugguu

SEQ ID NO: 36 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
acgcagcggcagucuuucat

SEQ ID NO: 37 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugaaagacugccgcugcguuu

SEQ ID NO: 38 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ugaccaccauccgccgaaat

SEQ ID NO: 39 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uuucggcggaugguggucauu

SEQ ID NO: 40 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
cgaaucggccucuucaauat

SEQ ID NO: 41 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uauugaagaggccgauucguu

SEQ ID NO: 42 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
cuucaauagcagugccgaat

SEQ ID NO: 43 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uucggcacugcuauugaaguu

SEQ ID NO: 44 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caguaucuccaccaaucuat

SEQ ID NO: 45 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagauugguggagauacuguu

SEQ ID NO: 46 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ccaccaaucucuccggcuat

SEQ ID NO: 47 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagccggagagauuggugguu

SEQ ID NO: 48 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caccaaucucuccggcuuat

SEQ ID NO: 49 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uaagccggagagauugguguu

SEQ ID NO: 50 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ccccucagcuuacgguauat

SEQ ID NO: 51 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uauaccguaagcugagggguu

SEQ ID NO: 52 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
cccucagcuuacgguaucat

SEQ ID NO: 53 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugauaccguaagcugaggguu

SEQ ID NO: 54 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacauucuat

SEQ ID NO: 55 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 56 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ggaaccgcacggagcgccat

SEQ ID NO: 57 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uggcgcuccgugcgguuccuu

SEQ ID NO: 58 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
acggagcgccucuccgacat

SEQ ID NO: 59 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugucggagaggcgcuccguuu

SEQ ID NO: 60 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
agcaagcgcaacucugugat

SEQ ID NO: 61 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ucacagaguugcgcuugcuuu

SEQ ID NO: 62 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
cagaugguccuccauuucat

SEQ ID NO: 63 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugaaauggaggaccaucuguu

SEQ ID NO: 64 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
ucuagaucuggaaccuuaat

SEQ ID NO: 65 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uuaagguuccagaucuagauu

SEQ ID NO: 66 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
cccacauuuaccucgaggat

SEQ ID NO: 67 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uccucgagguaaauguggguu

SEQ ID NO: 68 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
accgcuugguuugcaguuat

SEQ ID NO: 69 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uaacugcaaaccaagcgguuu

SEQ ID NO: 70 - RNA, 18 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide attached to a linker
ucucguggccuuaaugaa

SEQ ID NO: 71 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
uucauuaaggccacgagauu

SEQ ID NO: 72 - RNA, 19 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
cugggaggaugaauucgaa

SEQ ID NO: 73 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
ucgaauucauccucccaguu

SEQ ID NO: 74 - RNA, 19 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
caagguggguggcaucuaa

SEQ ID NO: 75 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-fluoro modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  misc_feature (18)..(19): Phosphorothioate linkage
  modified_base (19)..(19): 2'-fluoro modified nucleotide
  misc_feature (19)..(20): Phosphorothioate linkage
  modified_base (20)..(20): 2'-O-methyl modified nucleotide
uagaugccacccaccuuguu

SEQ ID NO: 76 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
gcgcggaccaacaauuuca

SEQ ID NO: 77 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
gaaauuguugguccgcgcuu

SEQ ID NO: 78 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
gagccaucuuugcaacgca

SEQ ID NO: 79 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
gcguugcaaagauggcucuu

SEQ ID NO: 80 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
agccaucuuugcaacgcaa

SEQ ID NO: 81 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
ugcguugcaaagauggcuuu

SEQ ID NO: 82 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
uuacgguaucuacauucua

SEQ ID NO: 83 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
agaauguagauaccguaauu

SEQ ID NO: 84 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
cccacauuuaccucgagga

SEQ ID NO: 85 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
ccucgagguaaauguggguu

SEQ ID NO: 86 - RNA, 18 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide attached to a linker
ucucguggccuuaaugga

SEQ ID NO: 87 - RNA, 20 nt, Artificial Sequence
  Description of Artificial Sequence: Synthetic oligonucleotide
  modified_base (1)..(1): Vinyl phosphonate 2'-fluoro modified nucleotide
  misc_feature (1)..(2): Phosphorothioate linkage
  modified_base (2)..(2): 2'-O-methyl modified nucleotide
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-O-methyl modified nucleotide
uucauuaaggccacgagauu

SEQ ID NO: 88-100 - skipped (13 entries)

SEQ ID NO: 101 - protein, 90 aa, Artificial Sequence
  Description of Artificial Sequence: Synthetic polypeptide
MLPAPKNLVASRVTEDSARLSWTAPDAAFDSFNIAYWEPGIGGEAIWLRVPGSERSYDLTGLKPGTEYKVWIHGVKGGASSPPLIARFTT

SEQ ID NO: 102 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGASSPPLIARFTT

SEQ ID NO: 103 - protein, 90 aa, Artificial Sequence
  Description of Artificial Sequence: Synthetic polypeptide
MLPAPKNLVVSRVTEDSARLSWTAPDAAFDSFAIAYWEPGIGGEAIWLRVPGSERSYDLTGLKPGTEYKVWIHGVKGGASSPPLIARFTT

SEQ ID NO: 104 - protein, 90 aa, Artificial Sequence
  Description of Artificial Sequence: Synthetic polypeptide
MLPAPKNLVVSRVTEDSARLSWTAPDAAFDSFNISYWEPGIGGEAIWLRVPGSERSYDLTGLKPGTEYKVWIHGVKGGASSPPLIARFTT

SEQ ID NO: 105 - protein, 89 aa, Artificial Sequence
  Description of Artificial Sequence: Synthetic polypeptide
MLPAPKNLVVSRVTEDSARLSWTAPDAAFDSFNIAYAEPGIGGEAIWLRVPGSRSYDLTGLKPGTEYKVWIHGVKGGASSPPLIARFTT

SEQ ID NO: 106 - protein, 90 aa, Artificial Sequence
  Description of Artificial Sequence: Synthetic polypeptide
MLPAPKNLVVSRVTEDSARLSWTAPDAAFDSFNIAYWEAGIGGEAIWLRVPGSERSYDLTGLKPGTEYKVWIHGVKGGASSPPLIARFTT

SEQ ID NO: 107 - protein, 90 aa, Artificial Sequence
  Description of Artificial Sequence: Synthetic polypeptide
MLPAPKNLVVSRVTEDSARLSWTAPDAAFDSFNIAYWEPAIGGEAIWLRVPGSERSYDLTGLKPGTEYKVWIHGVKGGASSPPLIARFTT

SEQ ID NO: 108 - protein, 90 aa, Artificial Sequence
  Description of Artificial Sequence: Synthetic polypeptide
MLPAPKNLVVSRVTEDSARLSWTAPDAAFDSFNIAYWEPGAGGEAIWLRVPGSERSYDLTGLKPGTEYKVWIHGVKGGASSPPLIARFTT

SEQ ID NO: 109 - protein, 90 aa, Artificial Sequence
  Description of Artificial Sequence: Synthetic polypeptide
MLPAPKNLVVSRVTEDSARLSWTAPDAAFDSFNIAYWEPGIAGEAIWLRVPGSERSYDLTGLKPGTEYKVWIHGVKGGASSPPLIARFTT

SEQ ID NO: 110 - protein, 90 aa, Artificial Sequence
  Description of Artificial Sequence: Synthetic polypeptide
MLPAPKNLVVSRVTEDSARLSWTAPDAAFDSFNIAYWEPGIGGEAIALRVPGSERSYDLTGLKPGTEYKVWIHGVKGGASSPPLIARFTT

SEQ ID NO: 111 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLAVPGSERSYDLTGLKPGTEYKVWIHGVKGGASSPPLIARFTT

SEQ ID NO: 112 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYAVWIHGVKGGASSPPLIARFTT

SEQ ID NO: 113 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVAIHGVKGGASSPPLIARFTT

SEQ ID NO: 114 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIAGVKGGASSPPLIARFTT

SEQ ID NO: 115 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGSSSPPLIARFTT

SEQ ID NO: 116 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGAASPPLIARFTT

SEQ ID NO: 117 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGASSAPLIARFTT

SEQ ID NO: 118 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGASSPPLAARFTT

SEQ ID NO: 119 - protein, 90 aa, Artificial Sequence
  Description of Artificial Sequence: Synthetic polypeptide
MLPAPKNLVVSRVTEDSARLSWTAPDAAFDSFNIAYWEPGIGGEAIWLRVPGSERSYDLTGLKPGTEYKVWIHGVKGGASSPPLIAAFTT

SEQ ID NO: 120-272 - skipped (153 entries)

SEQ ID NO: 273 - protein, 90 aa, Artificial Sequence
  Description of Artificial Sequence: Synthetic polypeptide
  MOD_RES (33)..(33): D, F, Y, or H
  MOD_RES (35)..(35): Y, G, A, or V
  MOD_RES (37)..(37): I, T, L, A, or H
  MOD_RES (39)..(39): S, Y or P
  MOD_RES (40)..(40): Y, G, Q, or R
  MOD_RES (41)..(41): G or P
  MOD_RES (42)..(42): A, Y, P, D, or S
  MOD_RES (47)..(47): A, C, D, E, F, G, H, I, K, L, N, Q, R, S, T, V, W, or Y
  MOD_RES (49)..(49): A, C, D, E, F, G, H, I, K, L, N, Q, R, S, T, V, W, or Y
  MOD_RES (69)..(69): W, N, S, or E
  MOD_RES (71)..(71): L, Y, or G
  MOD_RES (73)..(73): D, Q, H, or V
  MOD_RES (74)..(74): G or S
  MOD_RES (79)..(79): R, G, F, L, or D
  MOD_RES (80)..(80): W, S, P, or L
  MOD_RES (82)..(82): T, V, M, or S
  MOD_RES (85)..(85): A, C, D, E, F, G, H, I, K, L, N, Q, R, S, T, V, W, or Y
  MOD_RES (87)..(87): A, C, D, E, F, G, H, I, K, L, N, Q, R, S, T, V, W, or Y
MLPAPKNLVVSRVTEDSARLSWTAPDAAFDSFXIXYXEXXXXGEAIXLXVPGSERSYDLTGLKPGTEYXVXIXXVKGGXXSXPLXAXFTT

SEQ ID NO: 274-300 - skipped (27 entries)

SEQ ID NO: 301 - protein, 90 aa, Artificial Sequence
  Description of Artificial Sequence: Synthetic polypeptide
MLPAPKNLVVSRVTEDSARLSWTAPDAAFDSFPITYIEAVVLGEAIVLTVPGSERSYDLTGLKPGTEYPVGISGVKGGHNSMPLSAIFTT

SEQ ID NO: 302 - protein, 90 aa, Artificial Sequence
  Description of Artificial Sequence: Synthetic polypeptide
MLPAPKNLVVSEVTEDSARLSWQGVARAFDSFMINYSELFWMGEAIVLTVPGSERSYDLTGLKPGTEYVVRIKGVKGGKGSWPLHAHFTT

SEQ ID NO: 303 - protein, 90 aa, Artificial Sequence
  Description of Artificial Sequence: Synthetic polypeptide
MLPAPKNLVVSRVTEDSARLSWTAPDAAFDSFNIEYAETRWYGEAIVLTVPGSERSYDLTGLKPGTEYVVPIDGVKGGIASKPLSAIFTT

SEQ ID NO: 304 - protein, 90 aa, Artificial Sequence
  Description of Artificial Sequence: Synthetic polypeptide
MLPAPKNLVVSEVTEDSARLSWQGVARAFDSFLITYRDQIFAGEVIVLTVPGSERSYDLTGLKPGTEYPVWIQGVKGGSPSAPLSAESTT

SEQ ID NO: 305 - protein, 90 aa, Artificial Sequence
  Description of Artificial Sequence: Synthetic polypeptide
MLPAPKNLVVSEVTEDSARLSWQGVARAFDSFLITYREQIFAGEVIVLTVPGSERSYDLTGLKPGTEYWVYIWGVKGGKPSFPLRAGFTT

SEQ ID NO: 306 - protein, 90 aa, Artificial Sequence
  Description of Artificial Sequence: Synthetic polypeptide
MLPAPKNLVVSRVTEDSARLSWTAPDAAFDSFPIIYMETFSRGEAIVLTVPGSERSYDLTGLKPGTEYRVPIGGVKGGSSSCPLSAIFTT

SEQ ID NO: 307 - protein, 90 aa, Artificial Sequence
  Description of Artificial Sequence: Synthetic polypeptide
MLPAPKNLVVSDVTEDSARLSWQGVARAFDSFLITYREQIFAGEVIVLTVPGSERSYDLTGLKPGTEYPVWIQGVKGGSPSAPLSAEFTT

SEQ ID NO: 308-309 - skipped (2 entries)

SEQ ID NO: 310 - protein, 90 aa, Artificial Sequence
  Description of Artificial Sequence: Synthetic polypeptide
MLPAPKNLVVSRVTEDSARLSWTAPDAAFDSFKIAYIETATRGEAIVLTVPGSERSYDLTGLKPGTEYVVPIPGVKGGNTSSPLSAIFTT

SEQ ID NO: 311 - skipped

SEQ ID NO: 312 - protein, 90 aa, Artificial Sequence
  Description of Artificial Sequence: Synthetic polypeptide
MLPAPKNLVVSRVTEDSARLSWTAPDAAFDSFFIPYAEPSPTGEAIVLTVPGSERSYDLTGLKPGTEYSVLIHGVKGGHLSDPLSAISTT

SEQ ID NO: 313 - protein, 90 aa, Artificial Sequence
  Description of Artificial Sequence: Synthetic polypeptide
MLPAPKNLVVSRVTEDSARLSWTAPDAAFDSFLIAYPEDGFRGEAIVLTVPGSERSYDLTGLKPGTEYPVPILGVKGGGGSGPLSAIFTT

SEQ ID NO: 314 - protein, 90 aa, Artificial Sequence
  Description of Artificial Sequence: Synthetic polypeptide
MLPAPKNLVVSRVTEDSARLSWTAPDAAFDSFPIYYVENVVWGEAIVLTVPGSERSYDLTGLKPGTEYWEVIIGVKGGQCSRPLSAIFTT

SEQ ID NO: 315 - protein, 90 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTECPVWIQGVKGGSPSAPLSAEFTT

SEQ ID NO: 316 - protein, 89 aa, Artificial Sequence
  Description of Artificial Sequence: Synthetic polypeptide
MLPAPKNLVVSRVTEDSARLSWTAPDAAFDSFGIAYREFRPSGEAIVLTVPGSERSYDLTVETGYRNEVVICGVKGGPWSGPLSAIFTT

SEQ ID NO: 317 - protein, 90 aa, Artificial Sequence
  Description of Artificial Sequence: Synthetic polypeptide
MLPAPKNLVVSRVTEDSARLSWTAPDAAFDSFPILYTECVYRGEAIVLTVPGSERSYDLTGLKPGTEYHVPITGVKGGGGSWPLSAIFTT

SEQ ID NO: 318 - protein, 90 aa, Artificial Sequence
  Description of Artificial Sequence: Synthetic polypeptide
MLPAPKNLVVSRVTEDSARLSWTAPDAAFDSFNIMYHEIIYVGEAIVLTVPGSERSYDLTGLKPGTEYPVPIEGVKGGGTSGPLSAIFTT

SEQ ID NO: 319 - protein, 90 aa, Artificial Sequence
  Description of Artificial Sequence: Synthetic polypeptide
MLPAPKNLVVSRVTEDSARLSWTAPDAAFDSFAITYTEAALCGEAIVLTVPGSERSYDLTGLKPGTEYPVPINGVKGGGTSGPLSAIFTT

SEQ ID NO: 320 - protein, 90 aa, Artificial Sequence
  Description of Artificial Sequence: Synthetic polypeptide
MLPAPKNLVVARVTEDSARLSWTAPDAAIDSFPIDYSEYWWGGEAIVLTVPGSERSYDLTGLKPGTEYPVLITGVKGGYRSGPLSAIFTT

SEQ ID NO: 321 - protein, 90 aa, Artificial Sequence
  Description of Artificial Sequence: Synthetic polypeptide
MLPAPKNLVVSRVTEDSARLSWTAPDAAFDSFSIRYNEFIVAGEAIVLTVPGSERSYDLTGLKPGTEYDVPIAGVKGGGASWPLSAIVTT

SEQ ID NO: 322 - protein, 88 aa, Artificial Sequence
  Description of Artificial Sequence: Synthetic polypeptide
MLPAPKNLVVSRVTEDSARLSWTAPDAAFDSFWYLELQFAGEAIVLTVPGSERSYDLTGLKPGTEYNVPITGVKGGIISFPLSAIFTT

SEQ ID NO: 323 - protein, 90 aa, Artificial Sequence
  Description of Artificial Sequence: Synthetic polypeptide
MLPAPKNLVVSRVTEDSARLSWTAPDAAFDSFAIWYHEWYGDGEAIVLTVPGSERSYDLTGPKPGTEYRVRISGVKGGFESGPLSAIFTT

SEQ ID NO: 324 - protein, 90 aa, Artificial Sequence
  Description of Artificial Sequence: Synthetic polypeptide
MLPAPKNLVVSRVTEDSARLSWTAPDAAFDSFMIRYQEGTRWGEAIVLTVPGSERSYDLTGLKPGTEYIVMIAGVKGGQISLPLSAIFTT

SEQ ID NO: 325 - protein, 90 aa, Artificial Sequence
  Description of Artificial Sequence: Synthetic polypeptide
MLPAPKNLVVSRVTEDSARLSWTAPDAAFDSFPIWYLEKSYQGEAIVLTVPGSERSYDLTGLKPGTEYVVPIIGVKGGRDSCPLSAIFTT

SEQ ID NO: 326 - protein, 90 aa, Artificial Sequence
  Description of Artificial Sequence: Synthetic polypeptide
MLPAPKNLVVSEVTEDSARLSWQGVARAFDSFLITYREQIFAGEVIVLTVPGSERSYDLTGLKPGTEYPVWIQGVKGGSPSAPLSAEFTT

SEQ ID NO: 327 - protein, 89 aa, Artificial Sequence
  Description of Artificial Sequence: Synthetic polypeptide
MLPAPKNLVVSRVTEDSARLSWTAPDAAFDSFRISYAETVRQGEAIVLTVPGSERSYDLTVETGYRNWVMILGVKGGPGSLPLSAIFTT

SEQ ID NO: 328 - protein, 90 aa, Artificial Sequence
  Description of Artificial Sequence: Synthetic polypeptide
MLPAPKNLVVSEVTEDSARLSWQGVVRAFDSFLITYREQIFAGEVIVLTVPGSERSYDLTGLKPGTEYPVWIQGVKGGSPSAPLSAEFTT

SEQ ID NO: 329 - protein, 90 aa, Artificial Sequence
  Description of Artificial Sequence: Synthetic polypeptide
MLPAPKNLVVSRVTEDSARLSWTAPDAAFDSFWIEYWEAVGFGEAIVLTVPGSERSYDLTGLKPGTEYFVGIYGVKGGYLSAPLSAIFTT

SEQ ID NO: 330 - protein, 90 aa, Artificial Sequence
  Description of Artificial Sequence: Synthetic polypeptide
MLPAPKNLVVSRVTEDSARLSWTAPDAAFDSFIIHYVEQQLIGEAIVLTVPGSERSYDLTGLKPGTEYPVPITGVKGGACSWPLSAIFTT

SEQ ID NO: 331 - protein, 90 aa, Artificial Sequence
  Description of Artificial Sequence: Synthetic polypeptide
MLPAPKNLVVSRVTEDSARLSWTAPDAAFDSFTIEYSEHPIDGEAIPLFVPGSERSYDLTGLKPGTEYYVRIHGVKGGWFSHPLWAFFTT

SEQ ID NO: 332 - protein, 90 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTEYGVTIAGVKGGWRSKPLNAESTT

SEQ ID NO: 333 - protein, 90 aa, Artificial Sequence
  Description of Artificial Sequence: Synthetic polypeptide
MLPAPKNLVVSRVTEDSARLSWTAPDAAFDSFGIAYVESYWYGEAIVLTVPGSERSYDLTGLKPGTEYNVPIYGVKGGDGSGPLSAIFTT

SEQ ID NO: 334 - protein, 90 aa, Artificial Sequence
  Description of Artificial Sequence: Synthetic polypeptide
MLPAPKNLVVSRVTEDSARLSWTAPDAAFDSFYITYVELNLAGEAIVLTVPGSERSYDLTGLKPGTEYPVPILGVKGGSLSQPLSAIFTT

SEQ ID NO: 335 - protein, 90 aa, Artificial Sequence
  Description of Artificial Sequence: Synthetic polypeptide
MLPAPKNLVVSRVTEDSARLSWTAPDAAFDSFPISYIESIADGEAIVLTVPGSERSYDLTGLKPGTEYWVAIVGVKGGPFSWSLSAIVTT

SEQ ID NO: 336 - protein, 90 aa, Artificial Sequence
  Description of Artificial Sequence: Synthetic polypeptide
MLPAPKNLVVSEVTEDSARLSWQGVARAFDSFLITYREQIFAGEVIVPTVPGSERSYDLTGLKPGTEYPVPIAGVKGGGPSAPLSAIFTT

SEQ ID NO: 337 - protein, 90 aa, Artificial Sequence
  Description of Artificial Sequence: Synthetic polypeptide
MLPAPKNLVVSRVTEDSARLSWTTPDAAFDSFPIYYWEVTITGEAIYLSVPGSERSYDLTGLKPGTEYPVDIPGVKGGAASPPLSAIFTT

SEQ ID NO: 338 - protein, 90 aa, Artificial Sequence
  Description of Artificial Sequence: Synthetic polypeptide
MLPAPKNLVVSRVTEDSARLSWTAPDAAFDSFPILYLEHTVRSEAIVLTVPGSERSYDLTDLKPGTEYCVPIDGVKGGLRSRPLSAIFTT

SEQ ID NO: 339 - protein, 90 aa, Artificial Sequence
  Description of Artificial Sequence: Synthetic polypeptide
MLPAPKNLVVSRVTEDSARLSWTAPDAAFDSFPIPYTEPPDPGEAIVLTVPGSERSYDLTGLKPGTEYLVTILGVKGGSMSVPLSAIFTT

SEQ ID NO: 340 - protein, 90 aa, Artificial Sequence
  Description of Artificial Sequence: Synthetic polypeptide
MLPAPKNLVVSRVTEDSARLSWTAPDAAFDSFTIDYWENRCPGEAIVLTVPGSERSYDLTGLKPGTEYCVWISGVKGGYSSWPLSAIFTT

SEQ ID NO: 341 - protein, 90 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTEYPVWIQGVKGGHLSDPLSAIVTT

SEQ ID NO: 342 - protein, 90 aa, Artificial Sequence
  Description of Artificial Sequence: Synthetic polypeptide
MLPAPKNLVVSRVTEDSARLSWTAPDAAFDSFLIPYAETSPSGEAIVLTVPGSERSYDLTGLKPGTEYSVLIHGVKGGDYSEPLSAIFTT

SEQ ID NO: 343 - protein, 90 aa, Artificial Sequence
  Description of Artificial Sequence: Synthetic polypeptide
MLPAPKNLVVSRVTEDSARLSWTAPDAAFDSFMIVYYEYTRFGEAIVLTVPGSERSYDLTGLKPGTEYTVPIDGVKGGGRSSPLSAIFTT

SEQ ID NO: 344 - protein, 90 aa, Artificial Sequence
  Description of Artificial Sequence: Synthetic polypeptide
MLPAPKNLVVSRVTEDSARLSWTAPDAAFDSFFIPYAEPSPTGEAIVLTVPGSERSYDLTGLKPGTEYSVLIHGVKGGHLSDPLSAIVTT

SEQ ID NO: 345 - protein, 90 aa, Artificial Sequence; identical to SEQ ID NO: 326
  Description of Artificial Sequence: Synthetic polypeptide

SEQ ID NO: 346 - protein, 90 aa, Artificial Sequence
  Description of Artificial Sequence: Synthetic polypeptide
MLPAPKNLVVSRVTEDSARLSWTAPDAAFDSFIIPYAEVRPDGEAIVLTVPGSERSYDLTGLKPGTEYSVLIHGVKGGKLSLPLSAIFTT

SEQ ID NO: 347 - protein, 90 aa, Artificial Sequence
  Description of Artificial Sequence: Synthetic polypeptide
MLPAPKNLVVSRVTEDSARLSWTAPDAAFDSFGIVYLEMMVTGEAIVLTVPGSERSYDLTGLKPGTEYDVPILGVKGGTRSVPLSAIFTT

SEQ ID NO: 348 - protein, 94 aa, Artificial Sequence
  Description of Artificial Sequence: Synthetic polypeptide
MLPAPKNLVVSRVTEDSARLSWTAPDAAFDSFLIYYEEGYLEYYYSGEAIVLTVPGSERSYDLTGLKPGTEYYVGIVGVKGGGLSGPLSAISTT

SEQ ID NO: 349 - protein, 90 aa, Artificial Sequence
  Description of Artificial Sequence: Synthetic polypeptide
MLPAPKNLVVSRVTEDSARLSWTAPDAAFDSFPIAYAEPRPDGEAIVLTVPGSERSYDLTGLKPGTEYSVLIHGVKGGDWSLPLSAIFTT

SEQ ID NO: 350 - protein, 91 aa, Artificial Sequence
  Description of Artificial Sequence: Synthetic polypeptide
MSLPAPKNLVVSRVTEDSARLSWTAPDAAFDSFTIHYREFQLSGEAIVLTVPGSERSYDLTGLKPGTEYDVPIEGVKGGPGSRPLSAIFTT

SEQ ID NO: 351 - protein, 90 aa, Artificial Sequence
  Description of Artificial Sequence: Synthetic polypeptide
MLPAPKNLVVSEVTEDSARLSWQGVARAFDSFLITYREQIFAGEVIVLTVPGSECSYDLTGLKPGTEYPVWIQGVKGGSPSAPLSAEFTT

SEQ ID NO: 352 - protein, 90 aa, Artificial Sequence
  Description of Artificial Sequence: Synthetic polypeptide
MLPAPKNLVVSRVTEDSARLSWTAPDAAFDSFEIDYDELAIYGEAIVLTVPGSERSYDLTGLKPGTEYGVRIPGVKGGMPSLPLSAIVTT

SEQ ID NO: 353 - protein, 90 aa, Artificial Sequence
  Description of Artificial Sequence: Synthetic polypeptide
MLPAPENLVVSEVTEDSARLSWQGVARAFDSFLITYREQIFAGEVIVLTVPGSERSYDLTGLKPGTEYPVWIQGVKGGSPSAPLSAESTT

SEQ ID NO: 354 - protein, 90 aa, Artificial Sequence
  Description of Artificial Sequence: Synthetic polypeptide
MLPAPKNLVVSRVTEDSARLSWTAPDAAFDSFAIAYGEHIVIGEAIVLTVPGSERSYDLTGLKPGTEYMVPIAGVKGGPISLPLSAIFTT

SEQ ID NO: 355 - protein, 90 aa, Artificial Sequence
  Description of Artificial Sequence: Synthetic polypeptide
MLPAPKNLVVSRVTEDSARLSWTAPDAAFDSFFIPYAEPSPTGEAIVLTVPGSERSYDLTGLKPGTEYSVLIHGVKGGHLSDPLSAIFTT

SEQ ID NO: 356 - protein, 90 aa, Artificial Sequence
  Description of Artificial Sequence: Synthetic polypeptide
MLPAPKNLVVSRVTEDSARLSWTAPDAAFDSFSIGYVELVLLGEAIVLTVPGSERSYDLTGLKPGTEYDVLIPGVKGGSLSRPLSAIFTT

SEQ ID NO: 357 - protein, 90 aa, Artificial Sequence
  Description of Artificial Sequence: Synthetic polypeptide
MLPAPKNLVVSRVTEDSARLSWTAPDAAFDSFAIPYAELSRNGEAIVLTVPGSERSYDLTGLKPGTEYTVLIHGVKGGCLSDPLSAIFTT

SEQ ID NO: 358 - protein, 90 aa, Artificial Sequence
  Description of Artificial Sequence: Synthetic polypeptide
MLPAPKNLVVSRVTEDSARLSWTAPDAAFDSFHIEYLELSRHGEAIVLTVPGSERSYDLTGLKPGTEYWVMIFGVKGGGPSKPLSAIFTT

SEQ ID NO: 359 - protein, 88 aa, Artificial Sequence
  Description of Artificial Sequence: Synthetic polypeptide
MLPAPKNLVVSRVTEDSARLSWTAPDAAFDSFVYNEVHWIGEAIVLTVPGSERSYDLTGLKPGTEYFVGIYGVKGGHWSKPLSAIFTT

SEQ ID NO: 360 - protein, 90 aa, Artificial Sequence; identical to SEQ ID NO: 352
  Description of Artificial Sequence: Synthetic polypeptide

SEQ ID NO: 361 - protein, 90 aa, Artificial Sequence
  Description of Artificial Sequence: Synthetic polypeptide
MLPAPKNLVVSRVTEDSARLSWTAPDAAFDSFQIVYSELWIKGEAIVLTVPGSERSYDLTGLKPGTEYQVPIPGVKGGRNSFPLSAIFTT

SEQ ID NO: 362 - protein, 90 aa, Artificial Sequence
  Description of Artificial Sequence: Synthetic polypeptide
MLPAPKNLVVSRVTEDSARLSWTAPDAAFDSFKIRYTETRSIGEAIVLTVPGSERSYDLTGLKPGTEYCVPIGGVKGGDSSWPLSAISTT

SEQ ID NO: 363 - protein, 90 aa, Artificial Sequence
  Description of Artificial Sequence: Synthetic polypeptide
MLPAPKNLVVSRVTEDSARLSWTAPDAAFDSFCISYYERMGRGEAIVLTVPGSERSYDLTGLKPGTEYMVYIFGVKGGLNSLPLSAIFTT

SEQ ID NO: 364 - protein, 90 aa, Artificial Sequence
  Description of Artificial Sequence: Synthetic polypeptide
MLPAPKNLVVSRVTEDSARLSWTAPDAAFDSFYIVYAEPIPNGEAIVLTVPGSERSYDLTGLKPGTEYSVLIHGVKGGRNSDPLSAIFTT

SEQ ID NO: 365 - protein, 90 aa, Artificial Sequence
  Description of Artificial Sequence: Synthetic polypeptide
MLPAPKNLVVSRVTKDSARLSWTAPDAAFDSFPIAYAEPRPDGEAIVLTVPGSERSYDLTGLKPGTEYSVLIHGVKGGLLSSPLSAIFTT

SEQ ID NO: 366 - protein, 90 aa, Artificial Sequence
  Description of Artificial Sequence: Synthetic polypeptide
MLPAPKNLVVSRVTEDSARLSWTAPDAAFDSFTIDYDEPRSPGEAIVLTVPGSERSYDLTGLKPGTEYRVFIWGIKGGDTSFPLSAIFTT

SEQ ID NO: 367 - protein, 88 aa, Artificial Sequence
  Description of Artificial Sequence: Synthetic polypeptide
MLPAPKNLVVSRVTEDSARLSWTAPDAAFDSFTILYAEQAQFGEAIVLTVPGSERSYDLTGLKPGTEYPITGVKGGTRSGPLSAISTT

SEQ ID NO: 368 - protein, 90 aa, Artificial Sequence
  Description of Artificial Sequence: Synthetic polypeptide
MLPAPKNLVVSRVTEDSARLSWTAPDAAFDSFIIPYAEVRPDGEAIVLTVPGSERSYDLTGLKPGTEYSVLIHGVKGGHLSDPLSAISTT

SEQ ID NO: 369 - protein, 90 aa, Artificial Sequence
  Description of Artificial Sequence: Synthetic polypeptide
MLPAPKNLVVSRVTEDSARLSWTAPDAAFDSFHIAYEETATSGEAIYLRVPGSERSYDLTGLKPGTEYGVEIEGVKGGARSRPLYADFTT

SEQ ID NO: 370 - protein, 90 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTEYPVWIQGVKGGDLSNPLSAIFTT

SEQ ID NO: 371 - protein, 90 aa, Artificial Sequence
  Description of Artificial Sequence: Synthetic polypeptide
MLPAPKNLVVSRVTEDSARLSWTAPDAAFDSFPISYLELSLYGEAIVLTVPGSERSYDLTGLKPGTEYPVGIAGVKGGVVSRPLSAIFTT

SEQ ID NO: 372 - protein, 90 aa, Artificial Sequence
  Description of Artificial Sequence: Synthetic polypeptide
MLPAPKNLVVSRVTEDSARLSWTAPDAAFDSFTIGYREWYWYGEAIVLTVPGSERSYDLTGLKPGTEYNVPISGVKGGLDSFPLSAIFTT

SEQ ID NO: 373 - protein, 90 aa, Artificial Sequence
  Description of Artificial Sequence: Synthetic polypeptide
MLPAPKNLVVSEVTEDSARLSWQGVARAFDSFLITYREQIFAGEVIVLTVPGSERSYDLTGLKPGTEYPVWIQGVKGGSPSAPLSAESTT

SEQ ID NO: 374 - protein, 90 aa, Artificial Sequence
  Description of Artificial Sequence: Synthetic polypeptide
MLPAPKNLVVSRVTEDSARLSWTAPDAAFDSFSITYLEWWNLGEAIVLTVPGSERSYDLTGLKPGTEYMVTIPGVKGGMSSYPLSAIFTT

SEQ ID NO: 375 - protein, 90 aa, Artificial Sequence
  Description of Artificial Sequence: Synthetic polypeptide
MLPAPKNLVVSRVTEDSARLSWTAPDAAFDSFTISYGEEALIGEAIYLRVPGSERSYDLTGLKPGTEYYVHIEGVKGGSWSQPLAAAFTT

SEQ ID NO: 376 - protein, 90 aa, Artificial Sequence
  Description of Artificial Sequence: Synthetic polypeptide
MLPAPKNLVVSRVTEDSARLSWTAPDAAFDSFTIEYYENIGIGEAIVLTVPGSERSYDLTGLKPGTEYSVPIVGVKGGPYSHPLSAIFTT

SEQ ID NO: 377 - protein, 90 aa, Artificial Sequence
  Description of Artificial Sequence: Synthetic polypeptide
MLPAPKNLVVSRVTEDSARLSWTAPDAAFDSFPIAYAEPRPDGEAIVLTVPGSERSYDLTGLKPGTEYSVLIHGVKGGLLSSPLSAIFTT

SEQ ID NO: 378 - protein, 90 aa, Artificial Sequence
  Description of Artificial Sequence: Synthetic polypeptide
MLPAPKNLVVSRVTEDSARLSWTAPDAAFDSFGIGYYEHKRFGEAIQLSVPGSERSYDLTGLKPGTEYEVDIEGVKGGVLSWPLFAEFTT

SEQ ID NO: 379 - protein, 90 aa, Artificial Sequence
  Description of Artificial Sequence: Synthetic polypeptide
MLPAPKNLVVSRVTEDSARLSWTAPDAAFDSFVIEYTERFWSGEAIVLTVPGSERSYDLTGLKPGTEYSVPIDGVKGGQCSTPLSAIFTT

SEQ ID NO: 380 - protein, 90 aa, Artificial Sequence
  Description of Artificial Sequence: Synthetic polypeptide
MLPAPKNLVVSRVTEDSARLSWTAPDAAFDSFWIDYEEEGVIGEAIYLHVPGSERSYDLTGLKPGTEYVVKIHGVKGGHPSHPLVAVFTT

SEQ ID NO: 381 - protein, 90 aa, Artificial Sequence
  Description of Artificial Sequence: Synthetic polypeptide
MLPAPKNLVVSRVTEDSARLSWQGVARAFDSFLITYVELRHLGEAIVLTVPGSERSYDLTGLKPGTEYPVWIQGVKGGSPSAPLSAEFTT

SEQ ID NO: 382 - protein, 90 aa, Artificial Sequence
  Description of Artificial Sequence: Synthetic polypeptide
MLPAPKNLVVSRVTEDSARLSWTAPDAAFDSFLIPYAETSPSGEAIVLTVPGSERSYDLTGLKPGTEYSVLIHGVKGGDYSSPLSAIFTT

SEQ ID NO: 383 - protein, 90 aa, Artificial Sequence
  Description of Artificial Sequence: Synthetic polypeptide
MLPAPKNLVVSRVTEDSARLSWTAPDAAFDSFPIAYAEPRPDGEAIVLTVPGSERSYDLTGLKPGTEYSVLIHGVKGGLLSSPLSAISTT

SEQ ID NO: 384 - protein, 90 aa, Artificial Sequence
  Description of Artificial Sequence: Synthetic polypeptide
MLPAPKNLVVSRVTEDSARLSWQGVARAFDSFSILYLELTPKGEAIVLTVPGSERSYDLTGLKPGTEYPVWIQGVKGGSPSAPLSAEFTT

SEQ ID NO: 385 - protein, 90 aa, Artificial Sequence
  Description of Artificial Sequence: Synthetic polypeptide
MLPAPKNLVVSRVTEDSARLSWTAPDAAFDSFIIEYFEPIPIGEAIVLTVPGSERSYDLTGLKPGTEYAVNIYGVKGGYLSHPLSAIFTT

SEQ ID NO: 386 - protein, 90 aa, Artificial Sequence; identical to SEQ ID NO: 351
  Description of Artificial Sequence: Synthetic polypeptide

SEQ ID NO: 387 - protein, 90 aa, Artificial Sequence
  Description of Artificial Sequence: Synthetic polypeptide
MLPAPKNLVVSRVTEDSARLSWTAPDAAFDSFAIEYTEFLYSGEAIVLTVPGSERSYDLTGLKPGTEYGVPINGVKGGFVSPPLSAIVTT

SEQ ID NO: 388 - protein, 90 aa, Artificial Sequence
  Description of Artificial Sequence: Synthetic polypeptide
MLPAPKNLVVSRVTEDSARLSWTAPDAAFDSFPIKYREVLRCGEAIVLTVPGSERSYDLTGLKPGTEYTVPITGVKGGFGSSPLSAIFTT

SEQ ID NO: 389 - protein, 90 aa, Artificial Sequence
  Description of Artificial Sequence: Synthetic polypeptide
MLPAPENLVVSRVTEDSARLSWTAPDAAFDSFWIEYYEGVIQGEAIVLTVPGSERSYDLTGLKPGTEYFVAIWGVKGGKWSVPLSAIFTT

SEQ ID NO: 390 - protein, 86 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTEYPVWIQGVKGGSPSAEFTT

SEQ ID NO: 391 - protein, 90 aa, Artificial Sequence
  Description of Artificial Sequence: Synthetic polypeptide
MLPAPKNLVVSRVTEDSARLSWTAPDAAFDSFQIHYWETQGFGEAIVLTVPGSERSYDLTGLKPGTEYPVLIPGVKGGPSSLPLSAIFTT

SEQ ID NO: 392 - protein, 90 aa, Artificial Sequence; identical to SEQ ID NO: 355
  Description of Artificial Sequence: Synthetic polypeptide

SEQ ID NO: 393 - protein, 90 aa, Artificial Sequence
  Description of Artificial Sequence: Synthetic polypeptide
MLPAPKNLVVSRVTEDSARLSWTAPDAAFDSFAIEYYEPVPAGEAIYLDVPGSERSYDLTGLKPGTEYDVTIYGVKGGYYSHPLFASFTT

SEQ ID NO: 394 - protein, 90 aa, Artificial Sequence
  Description of Artificial Sequence: Synthetic polypeptide
MLPAPKNLVVSEVTEDSARLSWQGVARAFDSFLITYREQIFAGEVIVLTVPGSERSYDLTGLKPGTEYPVWIQGVKGGSPSAPLSAIFTT

SEQ ID NO: 395 - protein, 90 aa, Artificial Sequence; identical to SEQ ID NO: 326
  Description of Artificial Sequence: Synthetic polypeptide

SEQ ID NO: 396 - protein, 91 aa, Artificial Sequence
  Description of Artificial Sequence: Synthetic polypeptide
MSLPAPKNLVVSRVTEDSARLSWTAPDAAFDSFPIAYLEVFYEGEAIVLTVPGSERSYDLTGLKPGTEYQVPIEGVKGGAMSLPLSAIFTT

SEQ ID NO: 397 - protein, 90 aa, Artificial Sequence
  Description of Artificial Sequence: Synthetic polypeptide
MLPAPKNLVVSRVTEDSARLSWTAPDAAFDSFHIWYEEETTIGEAIYLHVPGSERSYDLTGLKPGTEYEVHITGVKGGPYSRPLFANFTT

SEQ ID NO: 398 - protein, 90 aa, Artificial Sequence
  Description of Artificial Sequence: Synthetic polypeptide
MLPAPKNLVVSRVTEDSARLSWTAPDAAFDSFGIAYDEWPEFGEAIVLTVPGSERSYDLTGLKPDTEYIVEIYGVKGGWFSWPLSAIFTT

SEQ ID NO: 399 - protein, 90 aa, Artificial Sequence
  Description of Artificial Sequence: Synthetic polypeptide
MLPAPKNLVVSRVTEDSARLSWTAPDAAFDSFFIPYAEPSPTGEAIVLTVPGSERSYDLTGLKPGTEYSVLIHGVKGGHLSDPLSVIFTT

SEQ ID NO: 400 - protein, 90 aa, Artificial Sequence
  Description of Artificial Sequence: Synthetic polypeptide
MLPAPKNLVVSRVTEDSARLSWTAPDAAFDSFYIWYEEVMYLGEAIVLTVPGSERSYDLTGLKPGTEYNVPIPGVKGGHSSPPLSAIFTT

SEQ ID NO: 401 - protein, 90 aa, Artificial Sequence
  Description of Artificial Sequence: Synthetic polypeptide
MLPAPKNLVVSRVTEDSARLSWTAPDAAFDSFHILYEELFLVGEAIVLTVPGSERSYDLTGLKPGTEYKVPISGVKGGPVSRPLSAIFTT

SEQ ID NO: 402 - protein, 90 aa, Artificial Sequence
  Description of Artificial Sequence: Synthetic polypeptide
MLPAPKNLVVSRVTEDSARLSWQGVARAFDSFLITYREQIFAGEVIVLTVPGSERSYDLTGLKPGTEYPVWIQGVKGGSPSAPLSAEFTT

SEQ ID NO: 403 - protein, 90 aa, Artificial Sequence
  Description of Artificial Sequence: Synthetic polypeptide
MLPAPKNLVVSRVTEDSARLSWTAPDAAFDSFHIVYHEPRPSGEAIWLHVPGSERSYDLTGLKPGTEYEVGIVSVKGGDLSVPLVAFFTT

SEQ ID NO: 404 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLLVPGSERSYDLTGLKPGTEYSVLIHGVKGGLLSSPLYAVFTT

SEQ ID NO: 405 - protein, 90 aa, Artificial Sequence
  Description of Artificial Sequence: Synthetic polypeptide
MLPAPKNLVVSRVTEDSARLSWTAPDAAFDSFYIAYAEPRPDGEAIFLVVPGSERSYDLTGLKPGTEYSVLIHGVKGGLLSSPLHANFTT

SEQ ID NO: 406 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLDVPGSERSYDLTGLKPGTEYSVLIHGVKGGLLSSPLYASFTT

SEQ ID NO: 407 - protein, 91 aa, Artificial Sequence
  Description of Artificial Sequence: Synthetic polypeptide
MSLPAPKNLVVSRVTEDSARLSWTAPDAAFDSFYIAYAEPRPDGEAISLYVPGSERSYDLTGLKPGTEYSVLIHGVKGGLLSSPLSAISTT

SEQ ID NO: 408 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLRVPGSERSYDLTGLKPGTEYNVTIQGVKGGFPSMPLSAIFTT

SEQ ID NO: 409 - protein, 90 aa, Artificial Sequence
  Description of Artificial Sequence: Synthetic polypeptide
MLPAPKNLVVSRVTEDSARLSWTAPDAAFDSFHISYEEDYTFGEAIYLRVPGSERSYDLTGLKPGTEYRVVIGGVKGGWFSEPLLAAFTT

SEQ ID NO: 410 - protein, 90 aa, Artificial Sequence
  Description of Artificial Sequence: Synthetic polypeptide
MLPAPKNLVVSRVTEDSARLSWTAPDAAFDSFFIGYLEPQPPGEAIYLTVPGSERSYDLTGLKPGTEYNVTIQGVKGGFPSYPLDASFTT

SEQ ID NO: 411 - protein, 93 aa, Artificial Sequence
  Description of Artificial Sequence: Synthetic polypeptide
MLPAPKNLVVSRVTEDSARLSWTAPDAAFDSFFIGYLEPQPPGEAIDLGVPGSERSYDLTGLKPGTEYNVTIQGVKGGFPSMPLDPLEAYFTT

SEQ ID NO: 412 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLLVPGSERSYDLTGLKPGTEYSVLIHGVKGGLLSSPLSAIFTT

SEQ ID NO: 413 - protein, 90 aa, Artificial Sequence
  Description of Artificial Sequence: Synthetic polypeptide
MLPAPKNLVVSRVTEDSARLSWTAPDAAFDSFYIAYAEPRPDGEAINLQVPGSERSYDLTGLKPGTEYSVLIHGVKGGLLSSPLVAFFTT

SEQ ID NO: 414 - protein, 90 aa, Artificial Sequence
  Description of Artificial Sequence: Synthetic polypeptide
MLPAPKNLVVSRVTEDSARLSWTTPDAAFDSFFIGYLEPQPPGEAISLQVPGSERSYDLTGLKPGTEYNVTIQGVKGGFPSSPLFAVFTT

SEQ ID NO: 415 - protein, 87 aa, Artificial Sequence
  Description of Artificial Sequence: Synthetic polypeptide
MLPAPKNLVVSRVTEDSARLSWTAPDAAFDSFYIAYAEPRPDGEAIELHVPGSERSYDLTGLKPGTEYSVLIHGVKGGLLSSPLFTT

SEQ ID NO: 416 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLVVPGSERSYDLTGLKPGTEYSVLIHGVKGGLLSSPLSAIFTT

SEQ ID NO: 417 - protein, 90 aa, Artificial Sequence
  Description of Artificial Sequence: Synthetic polypeptide
MLPAPKNLVVSRVTEDSARLSWTAPDAAFDSFYIAYAEPRPDGEAITLDVPGSERSYDLTGLKPGTEYSVLIHGVKGGLLSSPLSAIFTT

SEQ ID NO: 418 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLVVPGSERSYDLTGLKPGTEYSVLIHGVKGGLLSSPLVASFTT

SEQ ID NO: 419 - protein, 90 aa, Artificial Sequence
  Description of Artificial Sequence: Synthetic polypeptide
MLPAPKNLVVSRVTEDSARLSWTAPDAAFDSFYIAYAEPRPDGEAINLDVPGSERSYDLTGLKPGTEYSVLIHGVKGGLLSSPLVAEFTT

SEQ ID NO: 420 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLSVPGSERSYDLTGLKPGTEYSVLIHGVKGGLLSSPLVAIFTT

SEQ ID NO: 421 - protein, 90 aa, Artificial Sequence
  Description of Artificial Sequence: Synthetic polypeptide
MLPAPKNLVVSRVTEDSARLSWTAPDAAFDSFFIGYLEPQPPGEAIALWVPGSERSYDLTGLKPGTEYNVTIQGVKGGFPSMPLSAIFTT

SEQ ID NO: 422 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILVVPGSERSYDLTGLKPGTEYSVLIHGVKGGLLSSPLSAHFTT

SEQ ID NO: 423 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLWVPGSERSYDLTGLKPGTEYNVTIQGVKGGFPSHPLGAVFTT

SEQ ID NO: 424 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLHVPGSERSYDLTGLKPGTEYSVLIHGVKGGLLSSPLLASFTT

SEQ ID NO: 425 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALHVPGSERSYDLTGLKPGTEYSVLIHGVKGGLLSSPLVAFFTT

SEQ ID NO: 426 - protein, 90 aa, Artificial Sequence
  Description of Artificial Sequence: Synthetic polypeptide
MLPAPKNLVVSRVTEDSARLSWTAPDAAFDSFFIGYLEPQPPGEAIHLHVPGSERSYDLTGLKPGTEYNVTIQGVKGGFPSIPLHANFTT

SEQ ID NO: 427 - protein, 90 aa, Artificial Sequence
  Description of Artificial Sequence: Synthetic polypeptide
MLPAPKNLVVSRVTEDSARLSWTAPDAAFDSFYIAYAEPRPDGEAIFLGVPGSERSYDLTGLKPGTEYSVLIHGVKGGLLSSPLSAIFTT

SEQ ID NO: 428 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLRVPGSERSYDLTGLKPGTEYSVLIHGVKGGLLSSPLIASFTT

SEQ ID NO: 429 - protein, 90 aa, Artificial Sequence
  Description of Artificial Sequence: Synthetic polypeptide
MLPAPKNLVVSRVTEDSARLSWTAPDAAFDSFYIAYAEPRPDGEAINLWVPGSERSYDLTGLKPGTEYSVLIHGVKGGLLSSPLDASFTT

SEQ ID NO: 430 - protein, 90 aa, Artificial Sequence
  Description of Artificial Sequence: Synthetic polypeptide
MLPAPKNLVVSRVTEDSARLSWTAPDAAFDSFVIEYFEWTLNGEAIVLTVPGSERSYDLTGLKPGTEYSVQIYGVKGGCLSRPLSAIFTT

SEQ ID NO: 431 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLWVPGSERSYDLTGLKPGTEYSVLIHGVKGGLLSSPLIAHFTT

SEQ ID NO: 432 - protein, 90 aa, Artificial Sequence
  Description of Artificial Sequence: Synthetic polypeptide
MLPAPKNLVVSRVTEDSARLSWTAPDAAFDSFFIPYAEPSPTGEAIVLTVPGSERSYDLTGLKPGTEYSVLIHGVKGGLLSSPLSAHFTT

SEQ ID NO: 433 - protein, 90 aa, Artificial Sequence
  Description of Artificial Sequence: Synthetic polypeptide
MLPAPKNLVVSRVTEDSARLSWTAPDAAFDSFYIAYAEPRPDGEAIYLYVPGSERSYDLTGLKPGTEYSVLIHGVKGGLLSSPLDAFFTT

SEQ ID NO: 434 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLQVPGSERSYDLTGLKPGTEYSVLIHGVKGGLLSSPLSAIFTT

SEQ ID NO: 435 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLAVPGSERSYDLTGLKPGTEYSVLIHGVKGGLLSSPLHAFFTT

SEQ ID NO: 436 - protein, 90 aa, Artificial Sequence
  Description of Artificial Sequence: Synthetic polypeptide
MLPAPKNLVVSRVTEDSARLSWTAPDAAFDSFFIGYLEPQPPGEAIWLHVPGSERSYDLTGLKPGTEYNVTIQGVKGGFPSIPLIAIFTT

SEQ ID NO: 437 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLDVPGSERSYDLTGLKPGTEYSVLIHGVKGGLLSSPLVAEFTT

SEQ ID NO: 438 - protein, 90 aa, Artificial Sequence
  Description of Artificial Sequence: Synthetic polypeptide
MLPTPKNLVVSRVTEDSARLSWTAPDAAFDSFYIAYAEPRPDGEAIQLRVPGSERSYDLTGLKPGTEYSVLIHGVKGGLLSSPLHASFTT

SEQ ID NO: 439 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLGVPGSERSYDLTGLKPGTEYNVTIQGVKGGFPSHPLNANFTT

SEQ ID NO: 440 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLEVPGSERSYDLTGLKPGTEYNVTIQGVKGGFPSMPLSAIFTT

SEQ ID NO: 441 - protein, 90 aa, Artificial Sequence
  Description of Artificial Sequence: Synthetic polypeptide
MLPAPKNLVVSRVTEDSARLSWTAPDAAFDSFYIAYAEPRPDGEAIFLGVPGSERSYDLTGLKPGTEYSVLIHGVKGGLLSSPLIAFFTT

SEQ ID NO: 442 - protein, 90 aa, Artificial Sequence
  Description of Artificial Sequence: Synthetic polypeptide
MLPAPKNLVVSRVTEDSARLSWTAPDAAFDSFFIGYLEPQPPGEAIGLQVPGSERSYDLTGLKPGTEYNVTIQGVKGGFPSHPLKAQFTT

SEQ ID NO: 443 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLFVPGSERSYDLTGLKPGTEYSVLIHGVKGGLLSSPLVAHFTT

SEQ ID NO: 444 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLYVPGSERSYDLTGLKPGTEYSVLIHGVKGGLLSSPLGAFFTT

SEQ ID NO: 445 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLQVPGSERSYDLTGLKPGTEYSVLIHGVKGGLLSSPLTAIFTT

SEQ ID NO: 446 - protein, 90 aa, Artificial Sequence
  Description of Artificial Sequence: Synthetic polypeptide
MLPAPKNLVVSRVTEDSARLSWTAPDAAFDSFYIAYAEPRPDGEAITLHVPGSERSYDLTGLKPGTEYSVLIHGVKGGLLSSPLSAIFTT

SEQ ID NO: 447 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLEVPGSERSYDLTGLKPGTEYSVLIHGVKGGLLSSPLDAHFTT

SEQ ID NO: 448 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALHVPGSERSYDLTGLKPGTEYSVLIHGVKGGLLSSPLRAVFTT

SEQ ID NO: 449 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLWVPGSERSYDLTGLKPGTEYSVLIHGVKGGLLSSPLSAIFTT

SEQ ID NO: 450 - protein, 90 aa, Artificial Sequence
  Description of Artificial Sequence: Synthetic polypeptide
MLPAPKNLVVSRVTEDSARLSRTAPDAAFDSFYIAYAEPRPDGEAIVLIVPGSERSYDLTGLKPGTEYSVLIHGVKGGLLSSPLSAIFTT

SEQ ID NO: 451 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLWVPGSERSYDLTGLKPGTEYNVTIQGVKGGFPSRPLQAHFTT

SEQ ID NO: 452 - protein, 90 aa, Artificial Sequence
  Description of Artificial Sequence: Synthetic polypeptide
MLPAPKNLVVSRVTEDSARLSWTAPDAAFDSFYIAYAEPRPDGEAITLDVPGSERSYDLTGLKPGTEYSVLIHGVKGGLLSSPLYAFFTT

SEQ ID NO: 453 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALHVPGSERSYDLTGLKPGTEYSVLIHGVKGGLLSSPLSAIFTT

SEQ ID NO: 454 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLWVPGSERSYDLTGLKPGTEYSVLIHGVKGGLLSSPLIAHFTT

SEQ ID NO: 455 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLVVPGSERSYDLTGLKPGTEYSVLIHGVKGGLLSSPLHARFTT

SEQ ID NO: 456 - protein, 90 aa, Artificial Sequence
  Description of Artificial Sequence: Synthetic polypeptide
MLPAPKNLVVSRVTEDSARLSWTAPDAAFDSFYIAYAEPRPDGEAIFLQVPGSERSYDLTGLKPGTEYSVLIHGVKGGLLSSPLAAVFTT

SEQ ID NO: 457 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLHVPGSERSYDLTGLKPGTEYSVLIHGVKGGLLSSPLSAISTT

SEQ ID NO: 458 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILQVPGSERSYDLTGLKPGTEYSVLIHGVKGGLLSSPLSAVFTT

SEQ ID NO: 459 - protein, 90 aa, Artificial Sequence
  Description of Artificial Sequence: Synthetic polypeptide
MLPAPKNLVVSRVTEDSARLSWTAPDAAFDSFYIAYAEPRPDGEAIYLKVPGSERSYDLTGLKPGTEYSVLIHGVKGGLLSSPLVAHFTT

SEQ ID NO: 460 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLTVPGSERSYDLTGLKPGTEYSVLIHGVKGGLLSSPLLAYFTT

SEQ ID NO: 461 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILHVPGSERSYDLTGLKPGTEYSVLIHGVKGGLLSSPLEAKFTT

SEQ ID NO: 462 - protein, 89 aa, Artificial Sequence
  Description of Artificial Sequence: Synthetic polypeptide
MLPAPKNLVVSRVTEDSARLSWTAPDAAFDSFYIAYAEPRPDGEAIKLEVPGSERSYDLTGLKPGTEYSVLIHGVKGGLLSSPLAIFTT

SEQ ID NO: 463 - protein, 90 aa, Artificial Sequence
  Description of Artificial Sequence: Synthetic polypeptide
MLPAPKNLVVSRVTEDSARLSWTAPDAAFDSFFIGYLEPQPPGEAIYLEVPGSERSYDLTGLKPGTEYNVTIQGVKGGFPSFPLKAAFTT

SEQ ID NO: 464 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILRVPGSERSYDLTGLKPGTEYSVLIHGVKGGLLSSPLVAIFTT

SEQ ID NO: 465 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLQVPGSERSYDLTGLKPGTEYSVLIHGVKGGLLSSPLAAWFTT

SEQ ID NO: 466 - protein, 90 aa, Artificial Sequence
  Description of Artificial Sequence: Synthetic polypeptide
MLPAPKNLVVSRVTEDSARLSWTAPDAAFDSFYIAYAEPRPDGEAIFLQVPGSERSYDLTGLKPGTEYSVLIHGVKGGLLSSPLNAFFTT

SEQ ID NO: 467 - protein, 90 aa, Artificial Sequence
  Description of Artificial Sequence: Synthetic polypeptide
MLPAPKNLVVSRVTEDSARLSWTAPDAAFDSFFIGYLEPQPPGEAIILGVPGSERSYDLTGLKPGTEYSVLIHGVKGGLLSSPLHAYSTT

SEQ ID NO: 468 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLDVPGSERSYDLTGLKPGTEYSVLIHGVKGGLLSSPLSAIFTT

SEQ ID NO: 469 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLLVPGSERSYDLTGLKPGTEYSVLIHGVKGGLLSSPLSAVFTT

SEQ ID NO: 470 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLLVPGSERSYDLTGLKPGTEYSVLIHGVKGGLLSSPLLAHFTT

SEQ ID NO: 471 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLWVPGSERSYDLTGLKPGTEYSVLIHGVKGGLLSSPLDAYFTT

SEQ ID NO: 472 - protein, 89 aa, Artificial Sequence
  Description of Artificial Sequence: Synthetic polypeptide
MLPAPKNLVVSRVTEDSARLSWTAPDAAFDSFFIGYLEPQPPGEAIVLTVPGSERSYDLTGLKPGTEYNVTIQGVKGGFPSMPLASFTT

SEQ ID NO: 473 - protein, 90 aa, Artificial Sequence
  Description of Artificial Sequence: Synthetic polypeptide
MLPAPKNLVVSRVTEDSARLSWTAPDAAFDSFHIVYHEPRPSGEAIHLQVPGSERSYDLTGLKPGTEYNVTIQGVKGGFPSYPLSAFFTT

SEQ ID NO: 474 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLWVPGSERSYDLTGLKPGTEYNVTIQGVKGGFPSMPLSAIFTT

SEQ ID NO: 475 - protein, 90 aa, Artificial Sequence
  Description of Artificial Sequence: Synthetic polypeptide
MLPAPKNLVVSRVTEDSARLSWTAPDAAFDSFRISYCETFYHGEAIVLTVPGSERSYDLTGLKPGTEYSVLIHGVKGGLLSSPLIAKFTT

SEQ ID NO: 476 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLKVPGSERSYDLTGLKPGTEYSVLIHGVKGGLLSSPLQANFTT

SEQ ID NO: 477 - protein, 90 aa, Artificial Sequence; identical to SEQ ID NO: 476
  Description of Artificial Sequence: Synthetic polypeptide

SEQ ID NO: 478 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLQVPGSERSYDLTGLKPGTEYSVLIHGVKGGLLSSPLSAIVTT

SEQ ID NO: 479 - protein, 90 aa, Artificial Sequence
  Description of Artificial Sequence: Synthetic polypeptide
MLPAPKNLVVSRVTEDSARLSWTAPDAAFDSFPIAYAEPRPDGEAIVLTVPGSERSYDLTGLKPGTEYSVLIHGVKGGLLSSPLSAFFTT

SEQ ID NO: 480 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALLVPGSERSYDLTGLKPGTEYSVLIHGVKGGLLSSPLVAQFTT

SEQ ID NO: 481 - protein, 90 aa, Artificial Sequence; identical to SEQ ID NO: 461
  Description of Artificial Sequence: Synthetic polypeptide

SEQ ID NO: 482 - protein, 90 aa, Artificial Sequence
  Description of Artificial Sequence: Synthetic polypeptide
MLPAPKNLVVSRVTEDSARLSWTAPDAAFDSFYIAYAEPRPDGEAIDLHVPGSERSYDLTGLKPGTEYSVLIHGVKGGLLSSPLHALFTT

SEQ ID NO: 483 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLDVPGSERSYDLTGLKPGTEYSVLIHGVKGGFPSMPLSAIFTT

SEQ ID NO: 484 - protein, 88 aa, Artificial Sequence
  Description of Artificial Sequence: Synthetic polypeptide
MLPAPKNLVVSRVTEDSARLSWTAPDAAFDSFFIGYLEPQPPGEAIDLAVPGSERSYDLTGLKPGTEYSVLIHGVKGGLLSSPLSFTT

SEQ ID NO: 485 - protein, 90 aa, Artificial Sequence
  Description of Artificial Sequence: Synthetic polypeptide
MLPAPKNLVVSRVTEDSARLSWTAPDAAFDSFYIAYAEPRPDGEAIYLGVPGSERSYDLTGLKPGTEYSVLIHGVKGGLLSSPLRAKFTT

SEQ ID NO: 486 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLGVPGSERSYDLTGLKPGTEYSVLIHGVKGGLLSSPLSAIFTT

SEQ ID NO: 487 - protein, 88 aa, Artificial Sequence
  Description of Artificial Sequence: Synthetic polypeptide
MLPAPKNLVVSRVTEDSARLSWTAPDAAFDSFFIGYLEPQPPGEAISLLVPDSERSYDLTGLKPGTEYNVTIQGVKGGFPSMPLKFTT

SEQ ID NO: 488 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLGVPGSERSYDLTGLKPGTEYSVLIHGVKGGLLSSPLDASFTT

SEQ ID NO: 489 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLTVPGSERSYDLTGPKPGTEYWVLIQGVKGGGSSVPLVAYFTT

SEQ ID NO: 490 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLDVPGSERSYDLTGLKPGTEYSVLIHGVKGGLLSSPLEASFTT

SEQ ID NO: 491 - protein, 90 aa, Artificial Sequence
  Description of Artificial Sequence: Synthetic polypeptide
MLPAPKNLVVSRVTEDSARLSWTAPDAAFDSFFIGYLEPQPPGEAIILAVPGSERSYDLTGLKPGTEYNVTIQGVKGGFPSLPLVASFTT

SEQ ID NO: 492 - protein, 90 aa, Artificial Sequence
  Description of Artificial Sequence: Synthetic polypeptide
MLPAPKNLVVSRVTEDSARLSWTAPDAAFDSFDIGYTEYGGYGEAIYLSVPGSERSYDLTGLKPGTEYWVLIQGVKGGGSSVPLSAIFTT

SEQ ID NO: 493 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLSVPGSERSYDLTGLKPGTEYSVLIHGVKGGLLSSPLIANFTT

SEQ ID NO: 494 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALLVPGSERSYDLTGLKPGTEYSVLIHGVKGGLLSSPLSAIVTT

SEQ ID NO: 495 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILDVPGSERSYDLTGLKPGTEYSVLIHGVKGGLLSSPLSSIFTT

SEQ ID NO: 496 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLWVPGSERSYDLTGLKPGTEYSVLIHGVKGGLLSSPLRASFTT

SEQ ID NO: 497 - protein, 90 aa, Artificial Sequence
  Description of Artificial Sequence: Synthetic polypeptide
MLPAPKNLVVSRVTEDSARLSWTAPDAAFDSFYIAYAEPRPDGEAIKLDVPGSERSYDLTGLKPGTEYSVLIHGVKGGLLSSPLVAFFTT

SEQ ID NO: 498 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILEVPGSERSYDLTGLKPGTEYSVLIHGVKGGLLSSPLVAYFTT

SEQ ID NO: 499 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLWVPGSERSYDLTGLKPGTEYSVLIHGVKGGLLSSPLHADFTT

SEQ ID NO: 500 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLEVPGSERSYDLTGLKPGTEYSVLIHGVKGGLLSSPLVADFTT

SEQ ID NO: 501 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLWVPGSERSYDLTGLKPGTEYSVLIHGVKGGLLSSPLLAHFTT

SEQ ID NO: 502 - protein, 89 aa, Artificial Sequence
  Description of Artificial Sequence: Synthetic polypeptide
MLPAPKNLVVSRVTEDSARLSWTAPDAAFDSFDIGYTEYGGYGEAILHVPGSERSYDLTGLKPGTEYWVLIQGVKGGGSSVPLSAIFTT

SEQ ID NO: 503 - protein, 90 aa, Artificial Sequence
  Description of Artificial Sequence: Synthetic polypeptide
MLPAPKNLVVSRVTEDSARLSWTAPDAAFDSFFIGYLEPQPPGEAIVLLVPGSERSYDLTGLKPGTEYNVTIQGVKGGFPSVPLAAFFTT

SEQ ID NO: 504 - protein, 85 aa, Artificial Sequence
  Description of Artificial Sequence: Synthetic polypeptide
MLPAPKNLVVSRVTEDSARLSWTAPDAAFDSFFIGYLEPQPPGEAILLWVPGSERSYDLTGLKPGTEYNVTIQGVKGGFPSQFTT

SEQ ID NO: 505 - protein, 93 aa, Artificial Sequence
  Description of Artificial Sequence: Synthetic polypeptide
MLPAPKNLVVSRVTEDSARLSWTAPDAAFDSFFIGYLEPQPPGEAILLGVPGSERSYDLTGLKPGTEYNVTIQGVKGGFPSMPLHPLVALFTT

SEQ ID NO: 506 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLDVPGSERSYDLTGLKPGTEYSVLIHGVKGGLLSSPLSAIFTT

SEQ ID NO: 507 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLSVPGSERSYDLTGLKPGTEYSVLIHGVKGGLLSSPLAAYFTT

SEQ ID NO: 508 - protein, 90 aa, Artificial Sequence
  Description of Artificial Sequence: Synthetic polypeptide
MLPAPKNLVVSRVTEDSARLSWTAPDAAFDSFFIGYLEPQPPGEAIVLAVPGSERSYDLTGLKPGTEYNVTIQGVKGGFPSYPLVAAFTT

SEQ ID NO: 509 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLQVPGSCRSYDLTGLKPGTEYSVLIHGVKGGLLSSPLTAIFTT

SEQ ID NO: 510 - protein, 90 aa, Artificial Sequence
  Description of Artificial Sequence: Synthetic polypeptide
MLPAPKNLVVSRVTEDSARLSWTAPDAAFDSFFIGYLEPQPPGEAINLQVPGSERSYDLTGLKPGTEYNVTIQGVKGGFPSFPLSAVFTT

SEQ ID NO: 511 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLHVPGSERSYDLTGLKPGTEYSVLIHGVKGGLLSSPLVAIFTT

SEQ ID NO: 512 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLAVPGSERSYDLTGLKPGTEYSVLIHGVKGGLLSSPLHAQFTT

SEQ ID NO: 513 - protein, 87 aa, Artificial Sequence
  Description of Artificial Sequence: Synthetic polypeptide
MLPAPKNLVVSRVTEDSARLSWTAPDAAFDSFYIAYAEPRPDGEAILLGVPGSERSYDLTGLKPGTEYSVLIHGVKGGLLSSPLFTT

SEQ ID NO: 514 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLQVPGSERSYDLTGLKPGTEYSVLIHGVKGGLLSSPLCAEFTT

SEQ ID NO: 515 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLWVPGSERSYDLTGLKPGTEYSVLIHGVKGGLLSSPLIAEFTT

SEQ ID NO: 516 - protein, 88 aa, Artificial Sequence
  Description of Artificial Sequence: Synthetic polypeptide
MLPAPKNLVVSRVTEDSARLSWTAPDAAFDSFYIAYAEPRPDGEAISLSVPGSERSYDLTGLKPGTEYSVLIHGVKGGLLSSPPKFTT

SEQ ID NO: 517 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILEVPGSERSYDLTGLKPGTEYSVLIHGVKGGLLSSPLRAVFTT

SEQ ID NO: 518 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLVVPGSERSYDLTGLKPGTEYSVLIHGVKGGLLSSPLSAIFTT

SEQ ID NO: 519 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLKVPGSERSYDLTGLKPGTEYSVLIHGVKGGLLSSPLEAIFTT

SEQ ID NO: 520 - protein, 114 aa, Artificial Sequence
  Description of Artificial Sequence: Synthetic polypeptide
MLPAPKNPVVSRVTEDSARLSWTAPDAAFDSFYIAYAEPRPDGEAIHLLVPGSERSYDLTGLKPGTEYSVLIHGVKGGLLSSPLKRLSPPVVTITITMAVCRKPVAENLSQTLS

SEQ ID NO: 521 - protein, 89 aa, Artificial Sequence
  Description of Artificial Sequence: Synthetic polypeptide
MLPAPKNLVVSRVTEDSARLSWTAPDAAFDSFFIGYLEPQPPGEAIFLDVPGSERSYDLTGLKPGTEYNVTIQGVKGGFPSPLTAFFTT

SEQ ID NO: 522 - protein, 90 aa, Artificial Sequence
  Description of Artificial Sequence: Synthetic polypeptide
MLPAPKNLVVSRVTEDSARLSWTAPDAAFDSFFIGYLEPQPPGEAIVLDVPGSERSYDLTGLKPGTEYNVTIQGVKGGFPSHPLAAAFTT

SEQ ID NO: 523 - protein, 90 aa, Artificial Sequence
  Description of Artificial Sequence: Synthetic polypeptide
MLPAPKNLVVSRVTEDSARLSWTAPDAAFDSFFIGYLEPQPPGEAIGLAVPGSERSYDLTGLKPGTEYNVTIQGVKGGFPSVPLQANFTT

SEQ ID NO: 524 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLRVPGSERSYDLTGLKPGTEYSVLIHGVKGGLLSSPLVAEFTT

SEQ ID NO: 525 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLQVPGSERSYDLTGLKPGTEYSVLIHGVKGGLLSSPLSASFTT

SEQ ID NO: 526 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLHVPGSERSYDLTGLKPGTEYSVLIHGVKGGLLSSPLTASFTT

SEQ ID NO: 527 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLRVPGSERSYDLTGLKPGTEYSVLIHGVKGGLLSSPLSAIFTT

SEQ ID NO: 528 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLRVPGSERSYDLTGLKPGTEYSVLIHGVKGGLLSSPLAASFTT

SEQ ID NO: 529 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLLVPGSERSYDLTGLKPGTEYSVLIHGVKGGLLSSPLVAHFTT

SEQ ID NO: 530 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLLVPGSERSYDLTGLKPGTEYSVLIHGVKGGLLSSPLVAFFTT

SEQ ID NO: 531 - protein, 90 aa, Artificial Sequence
  Description of Artificial Sequence: Synthetic polypeptide
MLPAPKNLVVSRVTEDSARLSWTAPDAAFDSFFIGYLEPQPPGEAIHLYVPGSERSYDLTGLKPGTEYNVTIQGVKGGFPSDPLDAVFTT

SEQ ID NO: 532 - protein, 85 aa, Artificial Sequence
  Description of Artificial Sequence: Synthetic polypeptide
MLPAPKNLVVSRVTEDSARLSWTAPDAAFDSFFIGYLEPQPPGEAIYLDVPGSERSYDLTGLKPGTEYNVTIQGVKGGFPSTFTT

SEQ ID NO: 533 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLFVPGSERSYDLTGLKPGTEYSVLIHGVKGGLLSSPLKAYFTT

SEQ ID NO: 534 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLVVPGSERSYDLTGLKPGTEYSVLIHGVKGGLLSSPLSAIFTT

SEQ ID NO: 535 - protein, 90 aa, Artificial Sequence
  Description of Artificial Sequence: Synthetic polypeptide
MLPAPKNLVVSRVTEDSARLSWTAPDAAFDSFFIGYLEPQPPGEAIQLTVPGSERSYDLTGLKPGTEYNVTIQGVKGGFPSLPLSADFTT

SEQ ID NO: 536 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLQVPGSERSYDLTGLKPGTEYSVLIHGVKGGLLSSPLDAEFTT

SEQ ID NO: 537 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLAVPGSERSYDLTGLKPGTEYSVLIHGVKGGLLSSPLYASFTT

SEQ ID NO: 538 - protein, 88 aa, Artificial Sequence
  Description of Artificial Sequence: Synthetic polypeptide
MLPAPKNLVVSRVTEDSARLSWTTPDAAFDSFYIAYAEPRPDGEAIRLQVPGSERSYDLTGLKPGTEYSVLIHGVKGGLLSSPLGFTT

SEQ ID NO: 539 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLVVPGSERSYDLTGLKPGTEYSVLIHGVKGGLLSSPLYAIFTT

SEQ ID NO: 540 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLSVPGSERSYDLTGLKPGTEYSVLIHGVKGGLLSSPLHAKFTT

SEQ ID NO: 541 - protein, 90 aa, Artificial Sequence
  Description of Artificial Sequence: Synthetic polypeptide
MLPAPKNLVVSRVTEDSARLSWTAPDAAFDSFFIGYLEPQPPGEAIHLGVPGSERSYDLTGLKPGTEYNVTIQGVKGGFPSIPLFASFTT

SEQ ID NO: 542 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLLVPGSERSYDLTGLKPGTEYSVLIHGVKGGLLSSPLYAAFTT

SEQ ID NO: 543 - protein, 90 aa, Artificial Sequence
  Description of Artificial Sequence: Synthetic polypeptide
MLPAPKNLVVSRVTEDSARLSWTAPDAAFDSFFIGYLEPQPPGEAIHLAVPGSERSYDLTGLKPGTEYNVTIQGVKGGFPSVPLAAVFTT

SEQ ID NO: 544 - protein, 90 aa, Artificial Sequence
  Description of Artificial Sequence: Synthetic polypeptide
MLPAPKNLVVSRVTEDSARLSWTAPDAAFDSFYIAYAEPRPDGEAISLQVPGSERSYDLTGLKPGTEYSVLIHGVKGGLLSSPLGAHFTT

SEQ ID NO: 545 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALWVPGSERSYDLTGLKPGTEYSVLIHGVKGGLLSSPLVASFTT

SEQ ID NO: 546 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLHVPGSERSYDLTGLKPGTEYSVLIHGVKGGLLSSPLYAFFTT

SEQ ID NO: 547 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLHVPGSERSYDLTGLKPGTEYSVLIHGVKGGLLSSPLRASFTT

SEQ ID NO: 548 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLGVPGSERSYDLTGLKPGTEYSVLIHGVKGGLLSSPLHATFTT

SEQ ID NO: 549 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLEVPGSERSYDLTGLKPGTEYSVLIHGVKGGLLSSPLHANFTT

SEQ ID NO: 550 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLRVPGSERSYDLTGLKPGTEYSVLIHGVKGGLLSSPLYAKFTT

SEQ ID NO: 551 - protein, 90 aa, Artificial Sequence
  Description of Artificial Sequence: Synthetic polypeptide
MLPAPKNLVVSRVTEDSARLSWTAPDAAFDSFFIGYLEPQPPGEAIGLWVPGSERSYDLTGLKPGTEYNVTIQGVKGGFPSDPLQAVFTT

SEQ ID NO: 552 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLHVPGSERSYDLTGLKPGTEYSVLIHGVKGGLLSSPLDAFFTT

SEQ ID NO: 553 - protein, 90 aa, Artificial Sequence
  Description of Artificial Sequence: Synthetic polypeptide
MLPAPKNLVVSRVTEDSARLSWTAPDAAFDSFYIAYAEPRPDGEAIILHVPGSERSYDLTGLKPGTEYSVLIHGVKGGLLSSPLDAYFTT

SEQ ID NO: 554 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLAVPGSERSYDLTGLKPGTEYSVLIHGVKGGLLSSPLSAKFTT

SEQ ID NO: 555 - protein, 90 aa, Artificial Sequence
  Description of Artificial Sequence: Synthetic polypeptide
MLPAPKNLVVSRVTEDSARLSWTAPDAAFDSFFIGYLEPQPPGEAILLFVPGSERSYDLTGLKPGTEYNVTIQGVKGGFPSTPLSASFTT

SEQ ID NO: 556 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLTVPGSERSYDLTGLKPGTEYSVLIHGVKGGLLSSPLHAYFTT

SEQ ID NO: 557 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLGVPGSERSYDLTGLKPGTEYSVLIHGVKGGLLSSPLRAYFTT

SEQ ID NO: 558 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLEVPGSERSYDLTGLKPGTEYSVLIHGVKGGLLSSPLVAFFTT

SEQ ID NO: 559 - protein, 90 aa, Artificial Sequence
  Description of Artificial Sequence: Synthetic polypeptide
MLPAPKNLVVSRVTEDSARLSWTAPDAAFDSFYIAYAEPRPDGEAIQLGVPGSERSYDLTGLKPGTEYSVLIHGVKGGLLSSPLLAVFTT

SEQ ID NO: 560 - protein, 90 aa, Artificial Sequence
  Description of Artificial Sequence: Synthetic polypeptide
MLPAPKNLVVSRVTEDSARLSWTAPDAAFDSFYIAYAEPRPDGEAIHLRVPGSERSYDLTGLKPGTEYNVTIQGVKGGFPSMPLSAIFTT

SEQ ID NO: 561 - protein, 90 aa, Artificial Sequence
  Description of Artificial Sequence: Synthetic polypeptide
MLPAPKNLVVSRVTEDSARLSWTAPDAAFDSFYIAYAEPRPDGEAILLQVPGSERSYDLTGLKPGTEYSVLIHGVKGGLLSSPLIAKFTT

SEQ ID NO: 562 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLHVPGSERSYDLTGLKPGTEYSVLIHGVKGGLLSSPLQAIFTT

SEQ ID NO: 563 - protein, 90 aa, Artificial Sequence
  Description of Artificial Sequence: Synthetic polypeptide
MLPAPKNLVVSRVTEDSARLSWTAPDAAFDSFYIAYAEPRPDGEAIALVVPGSERSYDLTGLKPGTEYSVLIHGVKGGLLSSPLAANFTT

SEQ ID NO: 564 - protein, 90 aa, Artificial Sequence
  Description of Artificial Sequence: Synthetic polypeptide
MLPAPKNLVVSRVTEDSARLSWTAPDAAFDSFYIAYAEPRPDGEAINLSVPGSERSYDLTGLKPGTEYSVLIHGVKGGLLSSPLDAYFTT

SEQ ID NO: 565 - protein, 90 aa, Artificial Sequence
  Description of Artificial Sequence: Synthetic polypeptide
MLPAPKNLVVSRVTEDSARLSWTAPDAAFDSFYIAYAEPRPDGEAIVLEVPGSERSYDLTGLKPGTEYSVLIHGVKGGLLSSPLTASFTT

SEQ ID NO: 566 - protein, 90 aa, Artificial Sequence
  Description of Artificial Sequence: Synthetic polypeptide
MLPAPKNLVVSRVTEDSARLSWTAPDAAFDSFYIAYAEPRPDGEAIRLQVPGSERSYDLTGLKPGTEYSVLIHGVKGGLLSSPLGASFTT

SEQ ID NO: 567 - protein, 90 aa, Artificial Sequence
  Description of Artificial Sequence: Synthetic polypeptide
MLPAPKNLVVSRVTEDSARLSWTAPDAAFDSFYIAYAEPRPDGEAIGLWVPGSERSYDLTGLKPGTEYSVLIHGVKGGLLSSPLVAYFTT

SEQ ID NO: 568 - protein, 87 aa, Artificial Sequence
  Description of Artificial Sequence: Synthetic polypeptide
MLPAPKNLVVSRVTEDSARLSWTAPDAAFDSFYIAYAEPRPDGEAIYLEVPGSERSYDLTGLKPGTEYSVLIHGVKGGLLSSPLFTT

SEQ ID NO: 569 - protein, 90 aa, Artificial Sequence
  Description of Artificial Sequence: Synthetic polypeptide
MLPAPKNLVVSRVTEDSARLSWTAPDAAFDSFYIAYAEPRPDGEAIWLDVPGSERSYDLTGLKPGTEYSVLIHGVKGGLLSSPLDAYFTT

SEQ ID NO: 570 - protein, 90 aa, Artificial Sequence
  Description of Artificial Sequence: Synthetic polypeptide
MLPAPKNLVVSRVTEDSARLSWTAPDAAFDSFAIEYCETKMCGEAIVLTVPGSERSYDLTGLKPGTEYRVPIPGVKGGTASLPLSAIFTT

SEQ ID NO: 571 - protein, 90 aa, Artificial Sequence
  Description of Artificial Sequence: Synthetic polypeptide
MLPAPKNLVVSRVTEDSARLSWTAPDAAFDSFFIYYIESYPAGEAIVLTVPGSERSYDLTGLKPGTEYWVGIDGVKGGRWSTPLSAIFTT

SEQ ID NO: 572 - protein, 90 aa, Artificial Sequence
  Description of Artificial Sequence: Synthetic polypeptide
MLPAPKNLVVSRVTEDSARLSWTAPDAAFDSFFIYYIESYPAGEAIVLTVPGSCRSYDLTGLKPGTEYWVGIDGVKGGRWSTPLSAIFTT

SEQ ID NO: 573-591 - skipped (19 entries)

SEQ ID NO: 592 - protein, 189 aa, Artificial Sequence
  Description of Artificial Sequence: Synthetic polypeptide
MLPAPKNLVVSRVTEDSARLSWTAPDAAFDSFAIVYHEPRPDGEAIVLTVPGSCRSYDLTGLKPGTEYEVVILGVKGGVHSYPLSAIFTTAPAPAPAPAPLPAPKNLVVSRVTEDSARLSWTAPDAAFDSFAIVYHEPRPDGEAIVLTVPGSERSYDLTGLKPGTEYEVVILGVKGGVHSYPLSAIFTT

SEQ ID NO: 593 - protein, 199 aa, Artificial Sequence
  Description of Artificial Sequence: Synthetic polypeptide
MLPAPKNLVVSRVTEDSARLSWTAPDAAFDSFAIVYHEPRPDGEAIVLTVPGSCRSYDLTGLKPGTEYEVVILGVKGGVHSYPLSAIFTTGGGGSGGGGSGGGGSGGGGSLPAPKNLVVSRVTEDSARLSWTAPDAAFDSFAIVYHEPRPDGEAIVLTVPGSERSYDLTGLKPGTEYEVVILGVKGGVHSYPLSAIFTT

SEQ ID NO: 594 - protein, 199 aa, Artificial Sequence
  Description of Artificial Sequence: Synthetic polypeptide
MLPAPKNLVVSRVTEDSARLSWTAPDAAFDSFAIVYHEPRPDGEAIVLTVPGSCRSYDLTGLKPGTEYEVVILGVKGGVHSYPLSAIFTTEAAAKEAAAKEAAAKEAAAKLPAPKNLVVSRVTEDSARLSWTAPDAAFDSFAIVYHEPRPDGEAIVLTVPGSERSYDLTGLKPGTEYEVVILGVKGGVHSYPLSAIFTT

SEQ ID NO: 595 - protein, 184 aa, Artificial Sequence
  Description of Artificial Sequence: Synthetic polypeptide
MLPAPKNLVVSRVTEDSARLSWTAPDAAFDSFAIVYHEPRPDGEAIVLTVPGSCRSYDLTGLKPGTEYEVVILGVKGGVHSYPLSAIFTTEAAAKLPAPKNLVVSRVTEDSARLSWTAPDAAFDSFAIVYHEPRPDGEAIVLTVPGSERSYDLTGLKPGTEYEVVILGVKGGVHSYPLSAIFTT

SEQ ID NO: 596 - protein, 189 aa, Artificial Sequence
  Description of Artificial Sequence: Synthetic polypeptide
MLPAPKNLVVSRVTEDSARLSWTAPDAAFDSFKIEYFEYVGYGEAIVLTVPGSCRSYDLTGLKPGTEYYVAIYGVKGGWYSRPLSAIFTTAPAPAPAPAPLPAPKNLVVSRVTEDSARLSWTAPDAAFDSFKIEYFEYVGYGEAIVLTVPGSERSYDLTGLKPGTEYYVAIYGVKGGWYSRPLSAIFTT

SEQ ID NO: 597 - protein, 199 aa, Artificial Sequence
  Description of Artificial Sequence: Synthetic polypeptide
MLPAPKNLVVSRVTEDSARLSWTAPDAAFDSFKIEYFEYVGYGEAIVLTVPGSCRSYDLTGLKPGTEYYVAIYGVKGGWYSRPLSAIFTTGGGGSGGGGSGGGGSGGGGSLPAPKNLVVSRVTEDSARLSWTAPDAAFDSFKIEYFEYVGYGEAIVLTVPGSERSYDLTGLKPGTEYYVAIYGVKGGWYSRPLSAIFTT

SEQ ID NO: 598 - protein, 199 aa, Artificial Sequence
  Description of Artificial Sequence: Synthetic polypeptide
MLPAPKNLVVSRVTEDSARLSWTAPDAAFDSFKIEYFEYVGYGEAIVLTVPGSCRSYDLTGLKPGTEYYVAIYGVKGGWYSRPLSAIFTTEAAAKEAAAKEAAAKEAAAKLPAPKNLVVSRVTEDSARLSWTAPDAAFDSFKIEYFEYVGYGEAIVLTVPGSERSYDLTGLKPGTEYYVAIYGVKGGWYSRPLSAIFTT

SEQ ID NO: 599 - protein, 184 aa, Artificial Sequence
  Description of Artificial Sequence: Synthetic polypeptide
MLPAPKNLVVSRVTEDSARLSWTAPDAAFDSFKIEYFEYVGYGEAIVLTVPGSCRSYDLTGLKPGTEYYVAIYGVKGGWYSRPLSAIFTTEAAAKLPAPKNLVVSRVTEDSARLSWTAPDAAFDSFKIEYFEYVGYGEAIVLTVPGSERSYDLTGLKPGTEYYVAIYGVKGGWYSRPLSAIFTT

SEQ ID NO: 600 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaauucggat

SEQ ID NO: 601 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 602 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaauuaggat

SEQ ID NO: 603 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 604 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaaugaggat

SEQ ID NO: 605 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 606 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaauucgaat

SEQ ID NO: 607 - RNA, 21 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-fluoro modified nucleotide
  modified_base (4)..(4): 2'-fluoro modified nucleotide
  modified_base (5)..(5): 2'-fluoro modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-fluoro modified nucleotide
  modified_base (11)..(11): 2'-fluoro modified nucleotide
  modified_base (12)..(12): 2'-fluoro modified nucleotide
  modified_base (13)..(13): 2'-fluoro modified nucleotide
  modified_base (14)..(14): 2'-fluoro modified nucleotide
  modified_base (15)..(15): 2'-fluoro modified nucleotide
  modified_base (16)..(16): 2'-fluoro modified nucleotide
  modified_base (17)..(17): 2'-fluoro modified nucleotide
  modified_base (18)..(18): 2'-fluoro modified nucleotide
  modified_base (19)..(19): 2'-fluoro modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-fluoro modified nucleotide
uucgaauucauccucccaguu

SEQ ID NO: 608 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
cugggaggaugaauucgaat

SEQ ID NO: 609 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-fluoro modified nucleotide
  modified_base (4)..(4): 2'-fluoro modified nucleotide
  modified_base (5)..(5): 2'-fluoro modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-fluoro modified nucleotide
  modified_base (13)..(13): 2'-fluoro modified nucleotide
  modified_base (14)..(14): 2'-fluoro modified nucleotide
  modified_base (15)..(15): 2'-fluoro modified nucleotide
  modified_base (16)..(16): 2'-fluoro modified nucleotide
  modified_base (17)..(17): 2'-fluoro modified nucleotide
  modified_base (18)..(18): 2'-fluoro modified nucleotide
  modified_base (19)..(19): 2'-fluoro modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 610 - DNA, 15 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  misc_feature (13)..(14): Phosphorothioate linkage
  modified_base (14)..(14): 2'-fluoro modified nucleotide
  modified_base (15)..(15): Inverted deoxythymidine
cugggaggaugaaut

SEQ ID NO: 611 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  misc_feature (18)..(19): Phosphorothioate linkage
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 612 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcaucuaat

SEQ ID NO: 613 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 614 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcaucuagt

SEQ ID NO: 615 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 616 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcaucugat

SEQ ID NO: 617 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 618 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcaucgaat

SEQ ID NO: 619 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 620 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcauauaat

SEQ ID NO: 621 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 622 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcagcuaat

SEQ ID NO: 623 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 624 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcagcuagt

SEQ ID NO: 625 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 626 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaacgcat

SEQ ID NO: 627 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 628 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaacgcgt

SEQ ID NO: 629 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 630 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaacgaat

SEQ ID NO: 631 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 632 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaacacat

SEQ ID NO: 633 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 634 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcaaagcat

SEQ ID NO: 635 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 636 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcagcgcat

SEQ ID NO: 637 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 638 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
gagccaucuuugcagcgcgt

SEQ ID NO: 639 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 640 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacauucuat

SEQ ID NO: 641 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 642 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacauucugt

SEQ ID NO: 643 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 644 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacauucgat

SEQ ID NO: 645 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 646 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacauuguat

SEQ ID NO: 647 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 648 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacaugcuat

SEQ ID NO: 649 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 650 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacaugcuat

SEQ ID NO: 651 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 652 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacagucuat

SEQ ID NO: 653 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 654 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
uuacgguaucuacagucugt

SEQ ID NO: 655 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 656 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine
caagguggguggcaucuagt

SEQ ID NO: 657 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 658 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcaucuaat

SEQ ID NO: 659 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 660 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcaucuagt

SEQ ID NO: 661 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 662 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcaucugat

SEQ ID NO: 663 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 664 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcaucgaat

SEQ ID NO: 665 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 666 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcauauaat

SEQ ID NO: 667 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 668 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcagcuaat

SEQ ID NO: 669 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 670 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcagcuagt

SEQ ID NO: 671 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 672 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcaacgcat

SEQ ID NO: 673 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 674 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcaacgcgt

SEQ ID NO: 675 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 676 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcaacgaat

SEQ ID NO: 677 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 678 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcaacacat

SEQ ID NO: 679 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 680 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcaaagcat

SEQ ID NO: 681 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 682 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcagcgcat

SEQ ID NO: 683 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 684 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
gagccaucuuugcagcgcgt

SEQ ID NO: 685 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
ugcguugcaaagauggcucuu

SEQ ID NO: 686 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacauucuat

SEQ ID NO: 687 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 688 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacauucugt

SEQ ID NO: 689 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 690 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacauucgat

SEQ ID NO: 691 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 692 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacauuguat

SEQ ID NO: 693 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 694 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacaugcuat

SEQ ID NO: 695 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 696 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacaugcuat

SEQ ID NO: 697 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 698 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacagucuat

SEQ ID NO: 699 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 700 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
uuacgguaucuacagucugt

SEQ ID NO: 701 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 702 - DNA, 20 bp, Artificial Sequence
  Description of Artificial Sequence: Synthetic oligonucleotide
  Description of Combined DNA/RNA Molecule: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-O-methyl modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
  modified_base (20)..(20): Inverted deoxythymidine attached to a linker
caagguggguggcaucuagt

SEQ ID NO: 703 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-fluoro modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 704 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
uuacgguaucuacauucua

SEQ ID NO: 705 - RNA, 21 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 706 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
uuacgguaucuacauucua

SEQ ID NO: 707 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagaauguagauaccguaauu

SEQ ID NO: 708 - protein, 90 aa, Artificial Sequence
  Description of Artificial Sequence: Synthetic polypeptide
MLPAPKNLVVSRVTEDSARLSWTAPDAAFDSFAIVYHEPRPDGEAIVLTVPGSCRSYDLTGLKPGTEYEVVILGVKGGVHSYPLSAIFTT

SEQ ID NO: 709 - protein, 90 aa, Artificial Sequence
  Description of Artificial Sequence: Synthetic polypeptide
MLPAPKNLVVSRVTEDSARLSWTAPDAAFDSFAIVYHEPRPDGEAIVLTVPGSERSYDLTGLKPGTEYEVVILGVKGGVHSYPLSAIFTT

SEQ ID NO: 710 - protein, 90 aa, Artificial Sequence
  Description of Artificial Sequence: Synthetic polypeptide
MLPAPKNLVVSRVTEDSARLSWTAPDAAFDSFFIGYLEPQPPGEAIHLGVPGSCRSYDLTGLKPGTEYNVTIQGVKGGFPSIPLFASFTT

SEQ ID NO: 711 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide attached to a linker
uggacuucaaccuagacaa

SEQ ID NO: 712 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uugucuagguugaaguccauu

SEQ ID NO: 713-719 - skipped (7 entries)

SEQ ID NO: 720 - protein, 4 aa, Artificial Sequence
  Description of Artificial Sequence: Synthetic peptide
GSGS

SEQ ID NO: 721 - protein, 8 aa, Artificial Sequence
  Description of Artificial Sequence: Synthetic peptide
GGGSGGGS

SEQ ID NO: 722 - protein, 25 aa, Artificial Sequence
  Description of Artificial Sequence: Synthetic peptide
GGGGSGGGGSGGGGSGGGGSGGGGS

SEQ ID NO: 723 - protein, 4 aa, Artificial Sequence
  Description of Artificial Sequence: Synthetic peptide
APAP

SEQ ID NO: 724 - protein, 10 aa, Artificial Sequence
  Description of Artificial Sequence: Synthetic peptide
APAPAPAPAP

SEQ ID NO: 725 - protein, 20 aa, Artificial Sequence
  Description of Artificial Sequence: Synthetic peptide
APAPAPAPAPAPAPAPAPAP

SEQ ID NO: 726 - protein, 40 aa, Artificial Sequence
  Description of Artificial Sequence: Synthetic polypeptide
APAPAPAPAPAPAPAPAPAPAPAPAPAPAPAPAPAPAPAP

SEQ ID NO: 727 - protein, 29 aa, Artificial Sequence
  Description of Artificial Sequence: Synthetic peptide
AEAAAKEAAAKEAAAKEAAAKEAAAKAAA

SEQ ID NO: 728 - protein, 25 aa, Artificial Sequence
  Description of Artificial Sequence: Synthetic peptide
  SITE (1)..(25): This sequence may encompass 1-5 "Glu Ala Ala Ala Lys" repeating units
EAAAKEAAAKEAAAKEAAAKEAAAK

SEQ ID NO: 729 - protein, 20 aa, Artificial Sequence
  Description of Artificial Sequence: Synthetic peptide
EAAAKEAAAKEAAAKEAAAK

SEQ ID NO: 730 - protein, 20 aa, Artificial Sequence
  Description of Artificial Sequence: Synthetic peptide
GGGGSGGGGSGGGGSGGGGS

SEQ ID NO: 731 - protein, 10 aa, Artificial Sequence
  Description of Artificial Sequence: Synthetic peptide
APAPAPAPAP

SEQ ID NO: 732 - protein, 5 aa, Artificial Sequence
  Description of Artificial Sequence: Synthetic peptide
EAAAK

SEQ ID NO: 733-749 - skipped (17 entries)

SEQ ID NO: 750 - protein, 9 aa, Artificial Sequence
  Description of Artificial Sequence: Synthetic peptide
RKKRRQRRR

SEQ ID NO: 751 - protein, 16 aa, Artificial Sequence
  Description of Artificial Sequence: Synthetic peptide
RQIKIWFQNRRMKWKK

SEQ ID NO: 752 - protein, 26 aa, Artificial Sequence
  Description of Artificial Sequence: Synthetic peptide
GWTLNSAGYLLGKINKALAALAKKIL

SEQ ID NO: 753 - protein, 18 aa, Artificial Sequence
  Description of Artificial Sequence: Synthetic peptide
KLALKLALKALKAALKLA

SEQ ID NO: 754 - protein, 21 aa, Artificial Sequence
  Description of Artificial Sequence: Synthetic peptide
KETWWETWWTEWSQPKKKRKV

SEQ ID NO: 755 - protein, 4 aa, Artificial Sequence
  Description of Artificial Sequence: Synthetic peptide
KDEL

SEQ ID NO: 756 - protein, 29 aa, Artificial Sequence
  Description of Artificial Sequence: Synthetic peptide
WEAALAEALAELAEHLAEALAEALEALAA

SEQ ID NO: 757 - protein, 21 aa, Artificial Sequence
  Description of Artificial Sequence: Synthetic peptide
GDIMGEWGNEIFGAIAGFLGC

SEQ ID NO: 758 - protein, 13 aa, Artificial Sequence
  Description of Artificial Sequence: Synthetic peptide
GLFDIIKKIAESF

SEQ ID NO: 759 - protein, 24 aa, Artificial Sequence
  Description of Artificial Sequence: Synthetic peptide
GALFLGWLGAAGSTMGAPKSKRKV

SEQ ID NO: 760 - protein, 21 aa, Artificial Sequence
  Description of Artificial Sequence: Synthetic peptide
AGYLLGKINLKALAALAKKIL

SEQ ID NO: 761 - protein, 23 aa, Artificial Sequence
  Description of Artificial Sequence: Synthetic peptide
LIRLWSHLIHIWFQNRRLKWKKK

SEQ ID NO: 762 - protein, 36 aa, Artificial Sequence
  Description of Artificial Sequence: Synthetic polypeptide
GLFGAIAGFIENGWEGMIDGRQIKIWFQNRRMKWKK

SEQ ID NO: 763 - protein, 26 aa, Artificial Sequence
  Description of Artificial Sequence: Synthetic peptide
FFKKLAHALHLLALLALHLAHALKKA

SEQ ID NO: 764 - protein, 21 aa, Artificial Sequence
  Description of Artificial Sequence: Synthetic peptide
LFEAIEGFIENGWGMIDGWYG

SEQ ID NO: 765 - protein, 31 aa, Artificial Sequence
  Description of Artificial Sequence: Synthetic polypeptide
LFEAIEGFIENGWEGMIDGWYGRKKRRQRRR

SEQ ID NO: 766 - protein, 25 aa, Artificial Sequence
  Description of Artificial Sequence: Synthetic peptide
IGAVLKVLTTGLPALISWIKRKRQQ

SEQ ID NO: 767 - protein, 21 aa, Artificial Sequence
  Description of Artificial Sequence: Synthetic peptide
MKLAVTLTLVTLALSSSSASA

SEQ ID NO: 768-800 - skipped (33 entries)

SEQ ID NO: 801 - RNA, 19 nt, Artificial Sequence
  Description of Artificial Sequence: Synthetic oligonucleotide
caggggugcggucuugcaa

SEQ ID NO: 802 - RNA, 19 nt, Artificial Sequence
  Description of Artificial Sequence: Synthetic oligonucleotide
ggugcggucuugcaauagg

SEQ ID NO: 803 - RNA, 19 nt, Artificial Sequence
  Description of Artificial Sequence: Synthetic oligonucleotide
gugcggucuugcaauagga

SEQ ID NO: 804 - RNA, 19 nt, Artificial Sequence
  Description of Artificial Sequence: Synthetic oligonucleotide
agccaugccuuuaaaccgc

SEQ ID NO: 805 - RNA, 19 nt, Artificial Sequence
  Description of Artificial Sequence: Synthetic oligonucleotide
augccuuuaaaccgcacuu

SEQ ID NO: 806 - RNA, 19 nt, Artificial Sequence
  Description of Artificial Sequence: Synthetic oligonucleotide
ugggaggaugaauucgacc

SEQ ID NO: 807 - RNA, 19 nt, Artificial Sequence
  Description of Artificial Sequence: Synthetic oligonucleotide
aacgcagugcucuucgaag

SEQ ID NO: 808 - RNA, 19 nt, Artificial Sequence
  Description of Artificial Sequence: Synthetic oligonucleotide
ggacgaauggggcgacaac

SEQ ID NO: 809 - RNA, 19 nt, Artificial Sequence
  Description of Artificial Sequence: Synthetic oligonucleotide
ggcgacugccuguagcaac

SEQ ID NO: 810 - RNA, 19 nt, Artificial Sequence
  Description of Artificial Sequence: Synthetic oligonucleotide
cacgcugcuggggcgcuac

SEQ ID NO: 811 - RNA, 19 nt, Artificial Sequence
  Description of Artificial Sequence: Synthetic oligonucleotide
ugcgcucacgucuucacua

SEQ ID NO: 812 - RNA, 19 nt, Artificial Sequence
  Description of Artificial Sequence: Synthetic oligonucleotide
ccuuauacuucuuuaucgc

SEQ ID NO: 813 - RNA, 19 nt, Artificial Sequence
  Description of Artificial Sequence: Synthetic oligonucleotide
cuuuaucgccggccgcuau

SEQ ID NO: 814 - RNA, 19 nt, Artificial Sequence
  Description of Artificial Sequence: Synthetic oligonucleotide
ucgccggccgcuaugaguu

SEQ ID NO: 815 - RNA, 19 nt, Artificial Sequence
  Description of Artificial Sequence: Synthetic oligonucleotide
gccgcuaugaguucuccaa

SEQ ID NO: 816 - RNA, 19 nt, Artificial Sequence
  Description of Artificial Sequence: Synthetic oligonucleotide
ccgcuaugaguucuccaac

SEQ ID NO: 817 - RNA, 19 nt, Artificial Sequence
  Description of Artificial Sequence: Synthetic oligonucleotide
ggcucggcucaacuaucug

SEQ ID NO: 818 - RNA, 19 nt, Artificial Sequence
  Description of Artificial Sequence: Synthetic oligonucleotide
gcucggcucaacuaucugc

SEQ ID NO: 819 - RNA, 19 nt, Artificial Sequence
  Description of Artificial Sequence: Synthetic oligonucleotide
ucggcucaacuaucugcuc

SEQ ID NO: 820 - RNA, 19 nt, Artificial Sequence
  Description of Artificial Sequence: Synthetic oligonucleotide
ccagcgcggaccaacaauu

SEQ ID NO: 821 - RNA, 19 nt, Artificial Sequence
  Description of Artificial Sequence: Synthetic oligonucleotide
agcgcggaccaacaauuuc

SEQ ID NO: 822 - RNA, 19 nt, Artificial Sequence
  Description of Artificial Sequence: Synthetic oligonucleotide
ucgggaggaagcuuuauga

SEQ ID NO: 823 - RNA, 19 nt, Artificial Sequence
  Description of Artificial Sequence: Synthetic oligonucleotide
acgcagcggcagucuuucc

SEQ ID NO: 824 - RNA, 19 nt, Artificial Sequence
  Description of Artificial Sequence: Synthetic oligonucleotide
gaccaccauccgccgaauc

SEQ ID NO: 825 - RNA, 19 nt, Artificial Sequence
  Description of Artificial Sequence: Synthetic oligonucleotide
ccgaaucggccucuucaau

SEQ ID NO: 826 - RNA, 19 nt, Artificial Sequence
  Description of Artificial Sequence: Synthetic oligonucleotide
aaucggccucuucaauagc

SEQ ID NO: 827 - RNA, 19 nt, Artificial Sequence
  Description of Artificial Sequence: Synthetic oligonucleotide
caauagcagugccgacagg

SEQ ID NO: 828 - RNA, 19 nt, Artificial Sequence
  Description of Artificial Sequence: Synthetic oligonucleotide
aggaguuuguccguggcug

SEQ ID NO: 829 - RNA, 19 nt, Artificial Sequence
  Description of Artificial Sequence: Synthetic oligonucleotide
cggcugagugcacgguuau

SEQ ID NO: 830 - RNA, 19 nt, Artificial Sequence
  Description of Artificial Sequence: Synthetic oligonucleotide
ugggaauccccaguaucuc

SEQ ID NO: 831 - RNA, 19 nt, Artificial Sequence
  Description of Artificial Sequence: Synthetic oligonucleotide
cagaccccucagcuuacgg

SEQ ID NO: 832 - RNA, 19 nt, Artificial Sequence
  Description of Artificial Sequence: Synthetic oligonucleotide
ccccucagcuuacgguauc

SEQ ID NO: 833 - RNA, 19 nt, Artificial Sequence
  Description of Artificial Sequence: Synthetic oligonucleotide
cucagcuuacgguaucuac

SEQ ID NO: 834 - RNA, 19 nt, Artificial Sequence
  Description of Artificial Sequence: Synthetic oligonucleotide
gcuuacgguaucuacauuc

SEQ ID NO: 835 - RNA, 19 nt, Artificial Sequence
  Description of Artificial Sequence: Synthetic oligonucleotide
ccggcggcagcguaucauc

SEQ ID NO: 836 - RNA, 19 nt, Artificial Sequence
  Description of Artificial Sequence: Synthetic oligonucleotide
agcguaucauccagcggaa

SEQ ID NO: 837 - RNA, 19 nt, Artificial Sequence
  Description of Artificial Sequence: Synthetic oligonucleotide
gcguaucauccagcggaac

SEQ ID NO: 838 - RNA, 19 nt, Artificial Sequence
  Description of Artificial Sequence: Synthetic oligonucleotide
uaccuaggccgguacuaua

SEQ ID NO: 839 - RNA, 19 nt, Artificial Sequence
  Description of Artificial Sequence: Synthetic oligonucleotide
cuaggccgguacuauaugu

SEQ ID NO: 840 - RNA, 19 nt, Artificial Sequence
  Description of Artificial Sequence: Synthetic oligonucleotide
aggccgguacuauaugucu

SEQ ID NO: 841 - RNA, 19 nt, Artificial Sequence
  Description of Artificial Sequence: Synthetic oligonucleotide
ggccgguacuauaugucug

SEQ ID NO: 842 - RNA, 19 nt, Artificial Sequence
  Description of Artificial Sequence: Synthetic oligonucleotide
gccgguacuauaugucugc

SEQ ID NO: 843 - RNA, 19 nt, Artificial Sequence
  Description of Artificial Sequence: Synthetic oligonucleotide
cgguacuauaugucugcgc

SEQ ID NO: 844 - RNA, 19 nt, Artificial Sequence
  Description of Artificial Sequence: Synthetic oligonucleotide
gguacuauaugucugcgcg

SEQ ID NO: 845 - RNA, 19 nt, Artificial Sequence
  Description of Artificial Sequence: Synthetic oligonucleotide
cuauaugucugcgcgccac

SEQ ID NO: 846 - RNA, 19 nt, Artificial Sequence
  Description of Artificial Sequence: Synthetic oligonucleotide
uaugucugcgcgccacaug

SEQ ID NO: 847 - RNA, 19 nt, Artificial Sequence
  Description of Artificial Sequence: Synthetic oligonucleotide
augucugcgcgccacaugg

SEQ ID NO: 848 - RNA, 19 nt, Artificial Sequence
  Description of Artificial Sequence: Synthetic oligonucleotide
ucgcccucgcugucacgac

SEQ ID NO: 849 - RNA, 19 nt, Artificial Sequence
  Description of Artificial Sequence: Synthetic oligonucleotide
cggcgagcgcuacgaugag

SEQ ID NO: 850 - RNA, 19 nt, Artificial Sequence
  Description of Artificial Sequence: Synthetic oligonucleotide
caaggaccggcgcaacauc

SEQ ID NO: 851 - RNA, 19 nt, Artificial Sequence
  Description of Artificial Sequence: Synthetic oligonucleotide
acauccgugcaccagagug

SEQ ID NO: 852 - RNA, 19 nt, Artificial Sequence
  Description of Artificial Sequence: Synthetic oligonucleotide
cugggcgaggagcguaacu

SEQ ID NO: 853 - RNA, 19 nt, Artificial Sequence
  Description of Artificial Sequence: Synthetic oligonucleotide
gggcgaggagcguaacuaa

SEQ ID NO: 854 - RNA, 19 nt, Artificial Sequence
  Description of Artificial Sequence: Synthetic oligonucleotide
gcgaggagcguaacuaagu

SEQ ID NO: 855 - RNA, 19 nt, Artificial Sequence
  Description of Artificial Sequence: Synthetic oligonucleotide
gaggagcguaacuaagucc

SEQ ID NO: 856 - RNA, 19 nt, Artificial Sequence
  Description of Artificial Sequence: Synthetic oligonucleotide
aguccgccaaacacuccac

SEQ ID NO: 857 - RNA, 19 nt, Artificial Sequence
  Description of Artificial Sequence: Synthetic oligonucleotide
ggcgaucaaguccagagcc

SEQ ID NO: 858 - RNA, 19 nt, Artificial Sequence
  Description of Artificial Sequence: Synthetic oligonucleotide
cccuaaccuggcuuauucc

SEQ ID NO: 859 - RNA, 19 nt, Artificial Sequence
  Description of Artificial Sequence: Synthetic oligonucleotide
ugugaaaccacuagguucu

SEQ ID NO: 860 - RNA, 19 nt, Artificial Sequence
  Description of Artificial Sequence: Synthetic oligonucleotide
accacuagguucuaggucc

SEQ ID NO: 861 - RNA, 21 nt, Artificial Sequence
  Description of Artificial Sequence: Synthetic oligonucleotide
uugcaagaccgcaccccuguu

SEQ ID NO: 862 - RNA, 21 nt, Artificial Sequence
  Description of Artificial Sequence: Synthetic oligonucleotide
ccuauugcaagaccgcaccuu

SEQ ID NO: 863 - RNA, 21 nt, Artificial Sequence
  Description of Artificial Sequence: Synthetic oligonucleotide
uccuauugcaagaccgcacuu

SEQ ID NO: 864 - RNA, 21 nt, Artificial Sequence
  Description of Artificial Sequence: Synthetic oligonucleotide
gcgguuuaaaggcauggcuuu

SEQ ID NO: 865 - RNA, 21 nt, Artificial Sequence
  Description of Artificial Sequence: Synthetic oligonucleotide
aagugcgguuuaaaggcauuu

SEQ ID NO: 866 - RNA, 21 nt, Artificial Sequence
  Description of Artificial Sequence: Synthetic oligonucleotide
ggucgaauucauccucccauu

SEQ ID NO: 867 - RNA, 21 nt, Artificial Sequence
  Description of Artificial Sequence: Synthetic oligonucleotide
cuucgaagagcacugcguuuu

SEQ ID NO: 868 - RNA, 21 nt, Artificial Sequence
  Description of Artificial Sequence: Synthetic oligonucleotide
guugucgccccauucguccuu

SEQ ID NO: 869 - RNA, 21 nt, Artificial Sequence
  Description of Artificial Sequence: Synthetic oligonucleotide
guugcuacaggcagucgccuu

SEQ ID NO: 870 - RNA, 21 nt, Artificial Sequence
  Description of Artificial Sequence: Synthetic oligonucleotide
guagcgccccagcagcguguu

SEQ ID NO: 871 - RNA, 21 nt, Artificial Sequence
  Description of Artificial Sequence: Synthetic oligonucleotide
uagugaagacgugagcgcauu

SEQ ID NO: 872 - RNA, 21 nt, Artificial Sequence
  Description of Artificial Sequence: Synthetic oligonucleotide
gcgauaaagaaguauaagguu

SEQ ID NO: 873 - RNA, 21 nt, Artificial Sequence
  Description of Artificial Sequence: Synthetic oligonucleotide
auagcggccggcgauaaaguu

SEQ ID NO: 874 - RNA, 21 nt, Artificial Sequence
  Description of Artificial Sequence: Synthetic oligonucleotide
aacucauagcggccggcgauu

SEQ ID NO: 875 - RNA, 21 nt, Artificial Sequence
  Description of Artificial Sequence: Synthetic oligonucleotide
uuggagaacucauagcggcuu

SEQ ID NO: 876 - RNA, 21 nt, Artificial Sequence
  Description of Artificial Sequence: Synthetic oligonucleotide
guuggagaacucauagcgguu

SEQ ID NO: 877 - RNA, 21 nt, Artificial Sequence
  Description of Artificial Sequence: Synthetic oligonucleotide
cagauaguugagccgagccuu

SEQ ID NO: 878 - RNA, 21 nt, Artificial Sequence
  Description of Artificial Sequence: Synthetic oligonucleotide
gcagauaguugagccgagcuu

SEQ ID NO: 879 - RNA, 21 nt, Artificial Sequence
  Description of Artificial Sequence: Synthetic oligonucleotide
gagcagauaguugagccgauu

SEQ ID NO: 880 - RNA, 21 nt, Artificial Sequence
  Description of Artificial Sequence: Synthetic oligonucleotide
aauuguugguccgcgcugguu

SEQ ID NO: 881 - RNA, 21 nt, Artificial Sequence
  Description of Artificial Sequence: Synthetic oligonucleotide
gaaauuguugguccgcgcuuu

SEQ ID NO: 882 - RNA, 21 nt, Artificial Sequence
  Description of Artificial Sequence: Synthetic oligonucleotide
ucauaaagcuuccucccgauu

SEQ ID NO: 883 - RNA, 21 nt, Artificial Sequence
  Description of Artificial Sequence: Synthetic oligonucleotide
ggaaagacugccgcugcguuu

SEQ ID NO: 884 - RNA, 21 nt, Artificial Sequence
  Description of Artificial Sequence: Synthetic oligonucleotide
gauucggcggaugguggucuu

SEQ ID NO: 885 - RNA, 21 nt, Artificial Sequence
  Description of Artificial Sequence: Synthetic oligonucleotide
auugaagaggccgauucgguu

SEQ ID NO: 886 - RNA, 21 nt, Artificial Sequence
  Description of Artificial Sequence: Synthetic oligonucleotide
gcuauugaagaggccgauuuu

SEQ ID NO: 887 - RNA, 21 nt, Artificial Sequence
  Description of Artificial Sequence: Synthetic oligonucleotide
ccugucggcacugcuauuguu

SEQ ID NO: 888 - RNA, 21 nt, Artificial Sequence
  Description of Artificial Sequence: Synthetic oligonucleotide
cagccacggacaaacuccuuu

SEQ ID NO: 889 - RNA, 21 nt, Artificial Sequence
  Description of Artificial Sequence: Synthetic oligonucleotide
auaaccgugcacucagccguu

SEQ ID NO: 890 - RNA, 21 nt, Artificial Sequence
  Description of Artificial Sequence: Synthetic oligonucleotide
gagauacuggggauucccauu

SEQ ID NO: 891 - RNA, 21 nt, Artificial Sequence
  Description of Artificial Sequence: Synthetic oligonucleotide
ccguaagcugaggggucuguu

SEQ ID NO: 892 - RNA, 21 nt, Artificial Sequence
  Description of Artificial Sequence: Synthetic oligonucleotide
gauaccguaagcugagggguu

SEQ ID NO: 893 - RNA, 21 nt, Artificial Sequence
  Description of Artificial Sequence: Synthetic oligonucleotide
guagauaccguaagcugaguu

SEQ ID NO: 894 - RNA, 21 nt, Artificial Sequence
  Description of Artificial Sequence: Synthetic oligonucleotide
gaauguagauaccguaagcuu

SEQ ID NO: 895 - RNA, 21 nt, Artificial Sequence
  Description of Artificial Sequence: Synthetic oligonucleotide
gaugauacgcugccgccgguu

SEQ ID NO: 896 - RNA, 21 nt, Artificial Sequence
  Description of Artificial Sequence: Synthetic oligonucleotide
uuccgcuggaugauacgcuuu

SEQ ID NO: 897 - RNA, 21 nt, Artificial Sequence
  Description of Artificial Sequence: Synthetic oligonucleotide
guuccgcuggaugauacgcuu

SEQ ID NO: 898 - RNA, 21 nt, Artificial Sequence
  Description of Artificial Sequence: Synthetic oligonucleotide
uauaguaccggccuagguauu

SEQ ID NO: 899 - RNA, 21 nt, Artificial Sequence
  Description of Artificial Sequence: Synthetic oligonucleotide
acauauaguaccggccuaguu

SEQ ID NO: 900 - RNA, 21 nt, Artificial Sequence
  Description of Artificial Sequence: Synthetic oligonucleotide
agacauauaguaccggccuuu

SEQ ID NO: 901 - RNA, 21 nt, Artificial Sequence
  Description of Artificial Sequence: Synthetic oligonucleotide
cagacauauaguaccggccuu

SEQ ID NO: 902 - RNA, 21 nt, Artificial Sequence
  Description of Artificial Sequence: Synthetic oligonucleotide
gcagacauauaguaccggcuu

SEQ ID NO: 903 - RNA, 21 nt, Artificial Sequence
  Description of Artificial Sequence: Synthetic oligonucleotide
gcgcagacauauaguaccguu

SEQ ID NO: 904 - RNA, 21 nt, Artificial Sequence
  Description of Artificial Sequence: Synthetic oligonucleotide
cgcgcagacauauaguaccuu

SEQ ID NO: 905 - RNA, 21 nt, Artificial Sequence
  Description of Artificial Sequence: Synthetic oligonucleotide
guggcgcgcagacauauaguu

SEQ ID NO: 906 - RNA, 21 nt, Artificial Sequence
  Description of Artificial Sequence: Synthetic oligonucleotide
cauguggcgcgcagacauauu

SEQ ID NO: 907 - RNA, 21 nt, Artificial Sequence
  Description of Artificial Sequence: Synthetic oligonucleotide
ccauguggcgcgcagacauuu

SEQ ID NO: 908 - RNA, 21 nt, Artificial Sequence
  Description of Artificial Sequence: Synthetic oligonucleotide
gucgugacagcgagggcgauu

SEQ ID NO: 909 - RNA, 21 nt, Artificial Sequence
  Description of Artificial Sequence: Synthetic oligonucleotide
cucaucguagcgcucgccguu

SEQ ID NO: 910 - RNA, 21 nt, Artificial Sequence
  Description of Artificial Sequence: Synthetic oligonucleotide
gauguugcgccgguccuuguu

SEQ ID NO: 911 - RNA, 21 nt, Artificial Sequence
  Description of Artificial Sequence: Synthetic oligonucleotide
cacucuggugcacggauguuu

SEQ ID NO: 912 - RNA, 21 nt, Artificial Sequence
  Description of Artificial Sequence: Synthetic oligonucleotide
aguuacgcuccucgcccaguu

SEQ ID NO: 913 - RNA, 21 nt, Artificial Sequence
  Description of Artificial Sequence: Synthetic oligonucleotide
uuaguuacgcuccucgcccuu

SEQ ID NO: 914 - RNA, 21 nt, Artificial Sequence
  Description of Artificial Sequence: Synthetic oligonucleotide
acuuaguuacgcuccucgcuu

SEQ ID NO: 915 - RNA, 21 nt, Artificial Sequence
  Description of Artificial Sequence: Synthetic oligonucleotide
ggacuuaguuacgcuccucuu

SEQ ID NO: 916 - RNA, 21 nt, Artificial Sequence
  Description of Artificial Sequence: Synthetic oligonucleotide
guggaguguuuggcggacuuu

SEQ ID NO: 917 - RNA, 21 nt, Artificial Sequence
  Description of Artificial Sequence: Synthetic oligonucleotide
ggcucuggacuugaucgccuu

SEQ ID NO: 918 - RNA, 21 nt, Artificial Sequence
  Description of Artificial Sequence: Synthetic oligonucleotide
ggaauaagccagguuaggguu

SEQ ID NO: 919 - RNA, 21 nt, Artificial Sequence
  Description of Artificial Sequence: Synthetic oligonucleotide
agaaccuagugguuucacauu

SEQ ID NO: 920 - RNA, 21 nt, Artificial Sequence
  Description of Artificial Sequence: Synthetic oligonucleotide
ggaccuagaaccuagugguuu

SEQ ID NO: 921 - RNA, 19 nt, Artificial Sequence
  Description of Artificial Sequence: Synthetic oligonucleotide
caggggugcggucuugcaa

SEQ ID NO: 922 - RNA, 19 nt, Artificial Sequence
  Description of Artificial Sequence: Synthetic oligonucleotide
ggugcggucuugcaauaga

SEQ ID NO: 923 - RNA, 19 nt, Artificial Sequence
  Description of Artificial Sequence: Synthetic oligonucleotide
gugcggucuugcaauagga

SEQ ID NO: 924 - RNA, 19 nt, Artificial Sequence
  Description of Artificial Sequence: Synthetic oligonucleotide
agccaugccuuuaaaccga

SEQ ID NO: 925 - RNA, 19 nt, Artificial Sequence
  Description of Artificial Sequence: Synthetic oligonucleotide
augccuuuaaaccgcacua

SEQ ID NO: 926 - RNA, 19 nt, Artificial Sequence
  Description of Artificial Sequence: Synthetic oligonucleotide
ugggaggaugaauucgaca

SEQ ID NO: 927 - RNA, 19 nt, Artificial Sequence
  Description of Artificial Sequence: Synthetic oligonucleotide
aacgcagugcucuucgaaa

SEQ ID NO: 928 - RNA, 19 nt, Artificial Sequence
  Description of Artificial Sequence: Synthetic oligonucleotide
ggacgaauggggcgacaaa

SEQ ID NO: 929 - RNA, 19 nt, Artificial Sequence
  Description of Artificial Sequence: Synthetic oligonucleotide
ggcgacugccuguagcaaa

SEQ ID NO: 930 - RNA, 19 nt, Artificial Sequence
  Description of Artificial Sequence: Synthetic oligonucleotide
cacgcugcuggggcgcuaa

SEQ ID NO: 931 - RNA, 19 nt, Artificial Sequence
  Description of Artificial Sequence: Synthetic oligonucleotide
ugcgcucacgucuucacua

SEQ ID NO: 932 - RNA, 19 nt, Artificial Sequence
  Description of Artificial Sequence: Synthetic oligonucleotide
ccuuauacuucuuuaucga

SEQ ID NO: 933 - RNA, 19 nt, Artificial Sequence
  Description of Artificial Sequence: Synthetic oligonucleotide
cuuuaucgccggccgcuaa

SEQ ID NO: 934 - RNA, 19 nt, Artificial Sequence
  Description of Artificial Sequence: Synthetic oligonucleotide
ucgccggccgcuaugagua

SEQ ID NO: 935 - RNA, 19 nt, Artificial Sequence
  Description of Artificial Sequence: Synthetic oligonucleotide
gccgcuaugaguucuccaa

SEQ ID NO: 936 - RNA, 19 nt, Artificial Sequence
  Description of Artificial Sequence: Synthetic oligonucleotide
ccgcuaugaguucuccaaa

SEQ ID NO: 937 - RNA, 19 nt, Artificial Sequence
  Description of Artificial Sequence: Synthetic oligonucleotide
ggcucggcucaacuaucua

SEQ ID NO: 938 - RNA, 19 nt, Artificial Sequence
  Description of Artificial Sequence: Synthetic oligonucleotide
gcucggcucaacuaucuga

SEQ ID NO: 939 - RNA, 19 nt, Artificial Sequence
  Description of Artificial Sequence: Synthetic oligonucleotide
ucggcucaacuaucugcua

SEQ ID NO: 940 - RNA, 19 nt, Artificial Sequence
  Description of Artificial Sequence: Synthetic oligonucleotide
ccagcgcggaccaacaaua

SEQ ID NO: 941 - RNA, 19 nt, Artificial Sequence
  Description of Artificial Sequence: Synthetic oligonucleotide
agcgcggaccaacaauuua

SEQ ID NO: 942 - RNA, 19 nt, Artificial Sequence
  Description of Artificial Sequence: Synthetic oligonucleotide
ucgggaggaagcuuuauga

SEQ ID NO: 943 - RNA, 19 nt, Artificial Sequence
  Description of Artificial Sequence: Synthetic oligonucleotide
acgcagcggcagucuuuca

SEQ ID NO: 944 - RNA, 19 nt, Artificial Sequence
  Description of Artificial Sequence: Synthetic oligonucleotide
gaccaccauccgccgaaua

SEQ ID NO: 945 - RNA, 19 nt, Artificial Sequence
  Description of Artificial Sequence: Synthetic oligonucleotide
ccgaaucggccucuucaaa

SEQ ID NO: 946 - RNA, 19 nt, Artificial Sequence
  Description of Artificial Sequence: Synthetic oligonucleotide
aaucggccucuucaauaga

SEQ ID NO: 947 - RNA, 19 nt, Artificial Sequence
  Description of Artificial Sequence: Synthetic oligonucleotide
caauagcagugccgacaga

SEQ ID NO: 948 - RNA, 19 nt, Artificial Sequence
  Description of Artificial Sequence: Synthetic oligonucleotide
aggaguuuguccguggcua

SEQ ID NO: 949 - RNA, 19 nt, Artificial Sequence
  Description of Artificial Sequence: Synthetic oligonucleotide
cggcugagugcacgguuaa

SEQ ID NO: 950 - RNA, 19 nt, Artificial Sequence
  Description of Artificial Sequence: Synthetic oligonucleotide
ugggaauccccaguaucua

SEQ ID NO: 951 - RNA, 19 nt, Artificial Sequence
  Description of Artificial Sequence: Synthetic oligonucleotide
cagaccccucagcuuacga

SEQ ID NO: 952 - RNA, 19 nt, Artificial Sequence
  Description of Artificial Sequence: Synthetic oligonucleotide
ccccucagcuuacgguaua

SEQ ID NO: 953 - RNA, 19 nt, Artificial Sequence
  Description of Artificial Sequence: Synthetic oligonucleotide
cucagcuuacgguaucuaa

SEQ ID NO: 954 - RNA, 19 nt, Artificial Sequence
  Description of Artificial Sequence: Synthetic oligonucleotide
gcuuacgguaucuacauua

SEQ ID NO: 955 - RNA, 19 nt, Artificial Sequence
  Description of Artificial Sequence: Synthetic oligonucleotide
ccggcggcagcguaucaua

SEQ ID NO: 956 - RNA, 19 nt, Artificial Sequence
  Description of Artificial Sequence: Synthetic oligonucleotide
agcguaucauccagcggaa

SEQ ID NO: 957 - RNA, 19 nt, Artificial Sequence
  Description of Artificial Sequence: Synthetic oligonucleotide
gcguaucauccagcggaaa

SEQ ID NO: 958 - RNA, 19 nt, Artificial Sequence
  Description of Artificial Sequence: Synthetic oligonucleotide
uaccuaggccgguacuaua

SEQ ID NO: 959 - RNA, 19 nt, Artificial Sequence
  Description of Artificial Sequence: Synthetic oligonucleotide
cuaggccgguacuauauga

SEQ ID NO: 960 - RNA, 19 nt, Artificial Sequence
  Description of Artificial Sequence: Synthetic oligonucleotide
aggccgguacuauauguca

SEQ ID NO: 961 - RNA, 19 nt, Artificial Sequence
  Description of Artificial Sequence: Synthetic oligonucleotide
ggccgguacuauaugucua

SEQ ID NO: 962 - RNA, 19 nt, Artificial Sequence
  Description of Artificial Sequence: Synthetic oligonucleotide
gccgguacuauaugucuga

SEQ ID NO: 963 - RNA, 19 nt, Artificial Sequence
  Description of Artificial Sequence: Synthetic oligonucleotide
cgguacuauaugucugcga

SEQ ID NO: 964 - RNA, 19 nt, Artificial Sequence
  Description of Artificial Sequence: Synthetic oligonucleotide
gguacuauaugucugcgca

SEQ ID NO: 965 - RNA, 19 nt, Artificial Sequence
  Description of Artificial Sequence: Synthetic oligonucleotide
cuauaugucugcgcgccaa

SEQ ID NO: 966 - RNA, 19 nt, Artificial Sequence
  Description of Artificial Sequence: Synthetic oligonucleotide
uaugucugcgcgccacaua

SEQ ID NO: 967 - RNA, 19 nt, Artificial Sequence
  Description of Artificial Sequence: Synthetic oligonucleotide
augucugcgcgccacauga

SEQ ID NO: 968 - RNA, 19 nt, Artificial Sequence
  Description of Artificial Sequence: Synthetic oligonucleotide
ucgcccucgcugucacgaa

SEQ ID NO: 969 - RNA, 19 nt, Artificial Sequence
  Description of Artificial Sequence: Synthetic oligonucleotide
cggcgagcgcuacgaugaa

SEQ ID NO: 970 - RNA, 19 nt, Artificial Sequence
  Description of Artificial Sequence: Synthetic oligonucleotide
caaggaccggcgcaacaua

SEQ ID NO: 971 - RNA, 19 nt, Artificial Sequence
  Description of Artificial Sequence: Synthetic oligonucleotide
acauccgugcaccagagua

SEQ ID NO: 972 - RNA, 19 nt, Artificial Sequence
  Description of Artificial Sequence: Synthetic oligonucleotide
cugggcgaggagcguaaca

SEQ ID NO: 973 - RNA, 19 nt, Artificial Sequence
  Description of Artificial Sequence: Synthetic oligonucleotide
gggcgaggagcguaacuaa

SEQ ID NO: 974 - RNA, 19 nt, Artificial Sequence
  Description of Artificial Sequence: Synthetic oligonucleotide
gcgaggagcguaacuaaga

SEQ ID NO: 975 - RNA, 19 nt, Artificial Sequence
  Description of Artificial Sequence: Synthetic oligonucleotide
gaggagcguaacuaaguca

SEQ ID NO: 976 - RNA, 19 nt, Artificial Sequence
  Description of Artificial Sequence: Synthetic oligonucleotide
aguccgccaaacacuccaa

SEQ ID NO: 977 - RNA, 19 nt, Artificial Sequence
  Description of Artificial Sequence: Synthetic oligonucleotide
ggcgaucaaguccagagca

SEQ ID NO: 978 - RNA, 19 nt, Artificial Sequence
  Description of Artificial Sequence: Synthetic oligonucleotide
cccuaaccuggcuuauuca

SEQ ID NO: 979 - RNA, 19 nt, Artificial Sequence
  Description of Artificial Sequence: Synthetic oligonucleotide
ugugaaaccacuagguuca

SEQ ID NO: 980 - RNA, 19 nt, Artificial Sequence
  Description of Artificial Sequence: Synthetic oligonucleotide
accacuagguucuagguca

SEQ ID NO: 981 - RNA, 21 nt, Artificial Sequence
  Description of Artificial Sequence: Synthetic oligonucleotide
uugcaagaccgcaccccuguu

SEQ ID NO: 982 - RNA, 21 nt, Artificial Sequence
  Description of Artificial Sequence: Synthetic oligonucleotide
ucuauugcaagaccgcaccuu

SEQ ID NO: 983 - RNA, 21 nt, Artificial Sequence
  Description of Artificial Sequence: Synthetic oligonucleotide
uccuauugcaagaccgcacuu

SEQ ID NO: 984 - RNA, 21 nt, Artificial Sequence
  Description of Artificial Sequence: Synthetic oligonucleotide
ucgguuuaaaggcauggcuuu

SEQ ID NO: 985 - RNA, 21 nt, Artificial Sequence
  Description of Artificial Sequence: Synthetic oligonucleotide
uagugcgguuuaaaggcauuu

SEQ ID NO: 986 - RNA, 21 nt, Artificial Sequence
  Description of Artificial Sequence: Synthetic oligonucleotide
ugucgaauucauccucccauu

SEQ ID NO: 987 - RNA, 21 nt, Artificial Sequence
  Description of Artificial Sequence: Synthetic oligonucleotide
uuucgaagagcacugcguuuu

SEQ ID NO: 988 - RNA, 21 nt, Artificial Sequence
  Description of Artificial Sequence: Synthetic oligonucleotide
uuugucgccccauucguccuu

SEQ ID NO: 989 - RNA, 21 nt, Artificial Sequence
  Description of Artificial Sequence: Synthetic oligonucleotide
uuugcuacaggcagucgccuu

SEQ ID NO: 990 - RNA, 21 nt, Artificial Sequence
  Description of Artificial Sequence: Synthetic oligonucleotide
uuagcgccccagcagcguguu

SEQ ID NO: 991 - RNA, 21 nt, Artificial Sequence
  Description of Artificial Sequence: Synthetic oligonucleotide
uagugaagacgugagcgcauu

SEQ ID NO: 992 - RNA, 21 nt, Artificial Sequence
  Description of Artificial Sequence: Synthetic oligonucleotide
ucgauaaagaaguauaagguu

SEQ ID NO: 993 - RNA, 21 nt, Artificial Sequence
  Description of Artificial Sequence: Synthetic oligonucleotide
uuagcggccggcgauaaaguu

SEQ ID NO: 994 - RNA, 21 nt, Artificial Sequence
  Description of Artificial Sequence: Synthetic oligonucleotide
uacucauagcggccggcgauu

SEQ ID NO: 995 - RNA, 21 nt, Artificial Sequence
  Description of Artificial Sequence: Synthetic oligonucleotide
uuggagaacucauagcggcuu

SEQ ID NO: 996 - RNA, 21 nt, Artificial Sequence
  Description of Artificial Sequence: Synthetic oligonucleotide
uuuggagaacucauagcgguu

SEQ ID NO: 997 - RNA, 21 nt, Artificial Sequence
  Description of Artificial Sequence: Synthetic oligonucleotide
uagauaguugagccgagccuu

SEQ ID NO: 998 - RNA, 21 nt, Artificial Sequence
  Description of Artificial Sequence: Synthetic oligonucleotide
ucagauaguugagccgagcuu

SEQ ID NO: 999 - RNA, 21 nt, Artificial Sequence
  Description of Artificial Sequence: Synthetic oligonucleotide
uagcagauaguugagccgauu

SEQ ID NO: 1000 - RNA, 21 nt, Artificial Sequence
  Description of Artificial Sequence: Synthetic oligonucleotide
uauuguugguccgcgcugguu

SEQ ID NO: 1001 - RNA, 21 nt, Artificial Sequence
  Description of Artificial Sequence: Synthetic oligonucleotide
uaaauuguugguccgcgcuuu

SEQ ID NO: 1002 - RNA, 21 nt, Artificial Sequence
  Description of Artificial Sequence: Synthetic oligonucleotide
ucauaaagcuuccucccgauu

SEQ ID NO: 1003 - RNA, 21 nt, Artificial Sequence
  Description of Artificial Sequence: Synthetic oligonucleotide
ugaaagacugccgcugcguuu

SEQ ID NO: 1004 - RNA, 21 nt, Artificial Sequence
  Description of Artificial Sequence: Synthetic oligonucleotide
uauucggcggaugguggucuu

SEQ ID NO: 1005 - RNA, 21 nt, Artificial Sequence
  Description of Artificial Sequence: Synthetic oligonucleotide
uuugaagaggccgauucgguu

SEQ ID NO: 1006 - RNA, 21 nt, Artificial Sequence
  Description of Artificial Sequence: Synthetic oligonucleotide
ucuauugaagaggccgauuuu

SEQ ID NO: 1007 - RNA, 21 nt, Artificial Sequence
  Description of Artificial Sequence: Synthetic oligonucleotide
ucugucggcacugcuauuguu

SEQ ID NO: 1008 - RNA, 21 nt, Artificial Sequence
  Description of Artificial Sequence: Synthetic oligonucleotide
uagccacggacaaacuccuuu

SEQ ID NO: 1009 - RNA, 21 nt, Artificial Sequence
  Description of Artificial Sequence: Synthetic oligonucleotide
uuaaccgugcacucagccguu

SEQ ID NO: 1010 - RNA, 21 nt, Artificial Sequence
  Description of Artificial Sequence: Synthetic oligonucleotide
uagauacuggggauucccauu

SEQ ID NO: 1011 - RNA, 21 nt, Artificial Sequence
  Description of Artificial Sequence: Synthetic oligonucleotide
ucguaagcugaggggucuguu

SEQ ID NO: 1012 - RNA, 21 nt, Artificial Sequence
  Description of Artificial Sequence: Synthetic oligonucleotide
uauaccguaagcugagggguu

SEQ ID NO: 1013 - RNA, 21 nt, Artificial Sequence
  Description of Artificial Sequence: Synthetic oligonucleotide
uuagauaccguaagcugaguu

SEQ ID NO: 1014 - RNA, 21 nt, Artificial Sequence
  Description of Artificial Sequence: Synthetic oligonucleotide
uaauguagauaccguaagcuu

SEQ ID NO: 1015 - RNA, 21 nt, Artificial Sequence
  Description of Artificial Sequence: Synthetic oligonucleotide
uaugauacgcugccgccgguu

SEQ ID NO: 1016 - RNA, 21 nt, Artificial Sequence
  Description of Artificial Sequence: Synthetic oligonucleotide
uuccgcuggaugauacgcuuu

SEQ ID NO: 1017 - RNA, 21 nt, Artificial Sequence
  Description of Artificial Sequence: Synthetic oligonucleotide
uuuccgcuggaugauacgcuu

SEQ ID NO: 1018 - RNA, 21 nt, Artificial Sequence
  Description of Artificial Sequence: Synthetic oligonucleotide
uauaguaccggccuagguauu

SEQ ID NO: 1019 - RNA, 21 nt, Artificial Sequence
  Description of Artificial Sequence: Synthetic oligonucleotide
ucauauaguaccggccuaguu

SEQ ID NO: 1020 - RNA, 21 nt, Artificial Sequence
  Description of Artificial Sequence: Synthetic oligonucleotide
ugacauauaguaccggccuuu

SEQ ID NO: 1021 - RNA, 21 nt, Artificial Sequence
  Description of Artificial Sequence: Synthetic oligonucleotide
uagacauauaguaccggccuu

SEQ ID NO: 1022 - RNA, 21 nt, Artificial Sequence
  Description of Artificial Sequence: Synthetic oligonucleotide
ucagacauauaguaccggcuu

SEQ ID NO: 1023 - RNA, 21 nt, Artificial Sequence
  Description of Artificial Sequence: Synthetic oligonucleotide
ucgcagacauauaguaccguu

SEQ ID NO: 1024 - RNA, 21 nt, Artificial Sequence
  Description of Artificial Sequence: Synthetic oligonucleotide
ugcgcagacauauaguaccuu

SEQ ID NO: 1025 - RNA, 21 nt, Artificial Sequence
  Description of Artificial Sequence: Synthetic oligonucleotide
uuggcgcgcagacauauaguu

SEQ ID NO: 1026 - RNA, 21 nt, Artificial Sequence
  Description of Artificial Sequence: Synthetic oligonucleotide
uauguggcgcgcagacauauu

SEQ ID NO: 1027 - RNA, 21 nt, Artificial Sequence
  Description of Artificial Sequence: Synthetic oligonucleotide
ucauguggcgcgcagacauuu

SEQ ID NO: 1028 - RNA, 21 nt, Artificial Sequence
  Description of Artificial Sequence: Synthetic oligonucleotide
uucgugacagcgagggcgauu

SEQ ID NO: 1029 - RNA, 21 nt, Artificial Sequence
  Description of Artificial Sequence: Synthetic oligonucleotide
uucaucguagcgcucgccguu

SEQ ID NO: 1030 - RNA, 21 nt, Artificial Sequence
  Description of Artificial Sequence: Synthetic oligonucleotide
uauguugcgccgguccuuguu

SEQ ID NO: 1031 - RNA, 21 nt, Artificial Sequence
  Description of Artificial Sequence: Synthetic oligonucleotide
uacucuggugcacggauguuu

SEQ ID NO: 1032 - RNA, 21 nt, Artificial Sequence
  Description of Artificial Sequence: Synthetic oligonucleotide
uguuacgcuccucgcccaguu

SEQ ID NO: 1033 - RNA, 21 nt, Artificial Sequence
  Description of Artificial Sequence: Synthetic oligonucleotide
uuaguuacgcuccucgcccuu

SEQ ID NO: 1034 - RNA, 21 nt, Artificial Sequence
  Description of Artificial Sequence: Synthetic oligonucleotide
ucuuaguuacgcuccucgcuu

SEQ ID NO: 1035 - RNA, 21 nt, Artificial Sequence
  Description of Artificial Sequence: Synthetic oligonucleotide
ugacuuaguuacgcuccucuu

SEQ ID NO: 1036 - RNA, 21 nt, Artificial Sequence
  Description of Artificial Sequence: Synthetic oligonucleotide
uuggaguguuuggcggacuuu

SEQ ID NO: 1037 - RNA, 21 nt, Artificial Sequence
  Description of Artificial Sequence: Synthetic oligonucleotide
ugcucuggacuugaucgccuu

SEQ ID NO: 1038 - RNA, 21 nt, Artificial Sequence
  Description of Artificial Sequence: Synthetic oligonucleotide
ugaauaagccagguuaggguu

SEQ ID NO: 1039 - RNA, 21 nt, Artificial Sequence
  Description of Artificial Sequence: Synthetic oligonucleotide
ugaaccuagugguuucacauu

SEQ ID NO: 1040 - RNA, 21 nt, Artificial Sequence
  Description of Artificial Sequence: Synthetic oligonucleotide
ugaccuagaaccuagugguuu

SEQ ID NO: 1041 - RNA, 19 nt, Artificial Sequence
  Description of Artificial Sequence: Synthetic oligonucleotide
uggacuucaaccuagacaa

SEQ ID NO: 1042 - RNA, 21 nt, Artificial Sequence
  Description of Artificial Sequence: Synthetic oligonucleotide
uugucuagguugaaguccauu

SEQ ID NO: 1043 - RNA, 19 nt, Artificial Sequence
  Description of Artificial Sequence: Synthetic oligonucleotide
cugggaggaugaauucgaa

SEQ ID NO: 1044 - RNA, 21 nt, Artificial Sequence
  Description of Artificial Sequence: Synthetic oligonucleotide
uucgaauucauccucccaguu

SEQ ID NO: 1045 - RNA, 19 nt, Artificial Sequence
  Description of Artificial Sequence: Synthetic oligonucleotide
gggugacaacuacuaucua

SEQ ID NO: 1046 - RNA, 21 nt, Artificial Sequence
  Description of Artificial Sequence: Synthetic oligonucleotide
uagauaguaguugucacccuu

SEQ ID NO: 1047 - RNA, 19 nt, Artificial Sequence
  Description of Artificial Sequence: Synthetic oligonucleotide
cugggaggaugaauucgaa

SEQ ID NO: 1048 - RNA, 21 nt, Artificial Sequence
  Description of Artificial Sequence: Synthetic oligonucleotide
uucgaauucauccucccaguu

SEQ ID NO: 1049 - RNA, 19 nt, Artificial Sequence
  Description of Artificial Sequence: Synthetic oligonucleotide
caagguggguggcaucuaa

SEQ ID NO: 1050 - RNA, 21 nt, Artificial Sequence
  Description of Artificial Sequence: Synthetic oligonucleotide
uuagaugccacccaccuuguu

SEQ ID NO: 1051 - RNA, 19 nt, Artificial Sequence
  Description of Artificial Sequence: Synthetic oligonucleotide
uccgcagccuggaugauua

SEQ ID NO: 1052 - RNA, 21 nt, Artificial Sequence
  Description of Artificial Sequence: Synthetic oligonucleotide
uaaucauccaggcugcggauu

SEQ ID NO: 1053 - RNA, 19 nt, Artificial Sequence
  Description of Artificial Sequence: Synthetic oligonucleotide
  modified_base (1)..(1): 2'-O-methyl modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-fluoro modified nucleotide
  modified_base (8)..(8): 2'-fluoro modified nucleotide
  modified_base (9)..(9): 2'-fluoro modified nucleotide
  modified_base (10)..(10): 2'-O-methyl modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-O-methyl modified nucleotide
  modified_base (15)..(15): 2'-O-methyl modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-O-methyl modified nucleotide
gggugacaacuacuaucua

SEQ ID NO: 1054 - RNA, 21 nt, Artificial Sequence
  Description of Artificial Sequence: Synthetic oligonucleotide
  modified_base (1)..(1): Vinyl phosphonate 2'-O-methyl modified nucleotide
  modified_base (2)..(2): 2'-fluoro modified nucleotide
  misc_feature (2)..(3): Phosphorothioate linkage
  modified_base (3)..(3): 2'-O-methyl modified nucleotide
  misc_feature (3)..(4): Phosphorothioate linkage
  modified_base (4)..(4): 2'-O-methyl modified nucleotide
  modified_base (5)..(5): 2'-O-methyl modified nucleotide
  modified_base (6)..(6): 2'-O-methyl modified nucleotide
  modified_base (7)..(7): 2'-O-methyl modified nucleotide
  modified_base (8)..(8): 2'-O-methyl modified nucleotide
  modified_base (9)..(9): 2'-O-methyl modified nucleotide
  modified_base (10)..(10): 2'-O-methyl modified nucleotide
  modified_base (11)..(11): 2'-O-methyl modified nucleotide
  modified_base (12)..(12): 2'-O-methyl modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-O-methyl modified nucleotide
  modified_base (17)..(17): 2'-O-methyl modified nucleotide
  modified_base (18)..(18): 2'-O-methyl modified nucleotide
  modified_base (19)..(19): 2'-O-methyl modified nucleotide
  misc_feature (19)..(20): Phosphorothioate linkage
  modified_base (20)..(20): 2'-O-methyl modified nucleotide
  misc_feature (20)..(21): Phosphorothioate linkage
  modified_base (21)..(21): 2'-O-methyl modified nucleotide
uagauaguaguugucacccuu

SEQ ID NO: 1055 - RNA, 19 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-fluoro modified nucleotide
cugggaggaugaauucgaa

SEQ ID NO: 1056 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-O-methyl modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uucgaauucauccucccaguu

SEQ ID NO: 1057 - RNA, 19 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-fluoro modified nucleotide
caagguggguggcaucuaa

SEQ ID NO: 1058 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-O-methyl modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uuagaugccacccaccuuguu

SEQ ID NO: 1059 - RNA, 19 nt, Artificial Sequence
  Description of Artificial Sequence: Synthetic oligonucleotide
  modified_base (1)..(1): 2'-fluoro modified nucleotide
  misc_feature (1)..(2): Phosphorothioate linkage
  modified_base (2)..(2): 2'-O-methyl modified nucleotide
  misc_feature (2)..(3): Phosphorothioate linkage
  modified_base (3)..(3): 2'-fluoro modified nucleotide
  modified_base (4)..(4): 2'-O-methyl modified nucleotide
  modified_base (5)..(5): 2'-fluoro modified nucleotide
  modified_base (6)..(6): 2'-O-methyl modified nucleotide
  modified_base (7)..(7): 2'-fluoro modified nucleotide
  modified_base (8)..(8): 2'-O-methyl modified nucleotide
  modified_base (9)..(9): 2'-fluoro modified nucleotide
  modified_base (10)..(10): 2'-O-methyl modified nucleotide
  modified_base (11)..(11): 2'-fluoro modified nucleotide
  modified_base (12)..(12): 2'-O-methyl modified nucleotide
  modified_base (13)..(13): 2'-fluoro modified nucleotide
  modified_base (14)..(14): 2'-O-methyl modified nucleotide
  modified_base (15)..(15): 2'-fluoro modified nucleotide
  modified_base (16)..(16): 2'-O-methyl modified nucleotide
  modified_base (17)..(17): 2'-fluoro modified nucleotide
  modified_base (18)..(18): 2'-O-methyl modified nucleotide
  modified_base (19)..(19): 2'-fluoro modified nucleotide
uccgcagccuggaugauua

SEQ ID NO: 1060 - RNA, 21 nt, Artificial Sequence
  Description of Artificial Sequence: Synthetic oligonucleotide
  modified_base (1)..(1): Vinyl phosphonate 2'-O-methyl modified nucleotide
  misc_feature (1)..(2): Phosphorothioate linkage
  modified_base (2)..(2): 2'-fluoro modified nucleotide
  misc_feature (2)..(3): Phosphorothioate linkage
  modified_base (3)..(3): 2'-O-methyl modified nucleotide
  modified_base (4)..(4): 2'-fluoro modified nucleotide
  modified_base (5)..(5): 2'-O-methyl modified nucleotide
  modified_base (6)..(6): 2'-fluoro modified nucleotide
  modified_base (7)..(7): 2'-O-methyl modified nucleotide
  modified_base (8)..(8): 2'-fluoro modified nucleotide
  modified_base (9)..(9): 2'-O-methyl modified nucleotide
  modified_base (10)..(10): 2'-fluoro modified nucleotide
  modified_base (11)..(11): 2'-O-methyl modified nucleotide
  modified_base (12)..(12): 2'-fluoro modified nucleotide
  modified_base (13)..(13): 2'-O-methyl modified nucleotide
  modified_base (14)..(14): 2'-fluoro modified nucleotide
  modified_base (15)..(15): 2'-O-methyl modified nucleotide
  modified_base (16)..(16): 2'-fluoro modified nucleotide
  modified_base (17)..(17): 2'-O-methyl modified nucleotide
  modified_base (18)..(18): 2'-fluoro modified nucleotide
  modified_base (19)..(19): 2'-O-methyl modified nucleotide
  misc_feature (19)..(20): Phosphorothioate linkage
  modified_base (20)..(20): 2'-fluoro modified nucleotide
  misc_feature (20)..(21): Phosphorothioate linkage
  modified_base (21)..(21): 2'-O-methyl modified nucleotide
uaaucauccaggcugcggauu

SEQ ID NO: 1061 - protein, 22 aa, Artificial Sequence
  Description of Artificial Sequence: Synthetic peptide
RLIEDICLPRWGCLWEDDKDEL

SEQ ID NO: 1062 - protein, 17 aa, Artificial Sequence
  Description of Artificial Sequence: Synthetic peptide
MIRTLLLSTLVAGALSK

SEQ ID NO: 1063 - protein, 19 aa, Artificial Sequence
  Description of Artificial Sequence: Synthetic peptide
ILSSLTVTQLLRRLHQWIK

SEQ ID NO: 1064 - protein, 20 aa, Artificial Sequence
  Description of Artificial Sequence: Synthetic peptide
MIRTLLLSTLVAGALSKDEL

SEQ ID NO: 1065 - protein, 25 aa, Artificial Sequence
  Description of Artificial Sequence: Synthetic peptide
  SITE (1)..(25): This sequence may encompass 1-5 "Gly Gly Gly Gly Ser" repeating units
GGGGSGGGGSGGGGSGGGGSGGGGS

SEQ ID NO: 1066 - protein, 40 aa, Artificial Sequence; identical to SEQ ID NO: 726
  Description of Artificial Sequence: Synthetic polypeptide
  SITE (1)..(40): This sequence may encompass 1-20 "Ala Pro" repeating units

SEQ ID NO: 1067 - protein, 40 aa, Artificial Sequence; identical to SEQ ID NO: 726
  Description of Artificial Sequence: Synthetic polypeptide
  SITE (1)..(40): This sequence may encompass 2-20 "Ala Pro" repeating units

SEQ ID NO: 1068 - protein, 5 aa, Artificial Sequence
  Description of Artificial Sequence: Synthetic peptide
GGGGS

SEQ ID NO: 1069 - protein, 5 aa, Artificial Sequence
  Description of Artificial Sequence: Synthetic peptide
GGGGA

SEQ ID NO: 1070 - protein, 6 aa, Artificial Sequence
  Description of Artificial Sequence: Synthetic 6xHis tag
HHHHHH

SEQ ID NO: 1071 - RNA, 19 nt, Artificial Sequence
  Description of Artificial Sequence: Synthetic oligonucleotide
uuacgguaucuacauucua

SEQ ID NO: 1072 - RNA, 21 nt, Artificial Sequence
  Description of Artificial Sequence: Synthetic oligonucleotide
uagaauguagauaccguaauu

SEQ ID NO: 1073 - DNA, 20 bp, Artificial Sequence
  Description of Artificial Sequence: Synthetic oligonucleotide
  Description of Combined DNA/RNA Molecule: Synthetic oligonucleotide
  modified_base (20)..(20): Inverted deoxythymidine
caagguggguggcaucuagt

SEQ ID NO: 1074 - DNA, 20 bp, Artificial Sequence
  Description of Artificial Sequence: Synthetic oligonucleotide
  Description of Combined DNA/RNA Molecule: Synthetic oligonucleotide
  modified_base (20)..(20): Inverted deoxythymidine
gagccaucuuugcaacacat

SEQ ID NO: 1075 - RNA, 21 nt, Artificial Sequence
  Description of Artificial Sequence: Synthetic oligonucleotide
ugcguugcaaagauggcucuu

What is claimed is:

1. A composition comprising an siRNA molecule comprising a sense strand and an antisense strand, wherein the sense strand is a modified oligonucleotide 19-23 nucleotides in length that comprises the nucleobase sequence of SEQ ID NO: 1071 and the antisense strand is a modified oligonucleotide 21-23 nucleotides in length that comprises the nucleobase sequence of SEQ ID NO: 1072.

2. The composition of claim 1, wherein the sense strand comprises the modified oligonucleotide of SEQ ID NO: 704 and the antisense strand comprises the modified oligonucleotide of SEQ ID NO: 705.

3. The composition of claim 1, wherein the 5' end of the antisense strand further comprises a vinyl phosphonate modification, and wherein the 3' terminal nucleotide of the sense strand is attached to a linker.

4. The composition of claim 3, wherein the linker comprises a molecule having the formula of Mal-$C_2H_4C(O)$(NH)—$(CH_2)_6$.

5. The composition of claim 3, wherein the sense strand comprises the nucleic acid molecule of SEQ ID NO: 706 and the antisense strand comprises the nucleic acid molecule of SEQ ID NO: 707.

6. The composition of claim 1, further comprising a FN3 polypeptide domain linked to the sense strand of the siRNA molecule.

7. The composition of claim 6, wherein the sense strand of the siRNA molecule is linked to a cysteine residue in the FN3 polypeptide domain.

8. The composition of claim 6, wherein the FN3 polypeptide domain binds to CD71.

9. The composition of claim 8, wherein the CD71 comprises the amino acid sequence of SEQ ID NO: 2 or SEQ ID NO: 5.

10. The composition of claim 6, wherein the FN3 polypeptide domain comprises an amino acid sequence at least 98% identical to the amino acid sequence of one of SEQ ID NOs: 273, 301-307, 310, 312-572, 592-599, or 708-710.

11. A conjugate molecule comprising an siRNA molecule linked to a FN3 polypeptide domain, wherein the siRNA comprises a sense strand and an antisense strand; wherein the sense strand is a modified oligonucleotide 19-23 nucleotides in length that comprises the nucleobase sequence of SEQ ID NO: 1071 and the antisense strand is a modified oligonucleotide 21-23 nucleotides in length that comprises the nucleobase sequence of SEQ ID NO: 1072; wherein the FN3 polypeptide domain comprises a cysteine residue substitution at a position that corresponds to position 6, 8, 10, 11, 14, 15, 16, 20, 30, 34, 38, 40, 41, 45, 47, 48, 53, 54, 59, 60, 62, 64, 70, 88, 89, or 90 of SEQ ID NO: 445; and wherein the sense strand of the siRNA molecule is linked to the FN3 polypeptide domain at the cysteine residue.

12. The conjugate molecule of claim 11, wherein the cysteine residue substitution in the FN3 polypeptide domain is located at a residue that corresponds to position 54 of SEQ ID NO: 445.

13. The conjugate molecule of claim 11, wherein the FN3 polypeptide domain comprises the amino acid sequence of any one of SEQ ID NOs: 273, 301-307, 310, 312-572, 592-599, or 708-710.

14. The conjugate molecule of claim 11, wherein the FN3 polypeptide domain comprises the amino acid sequence of SEQ ID NO: 509.

15. A composition comprising a FN3 polypeptide domain linked by a linker to an siRNA molecule comprising a sense strand and an antisense strand, wherein the FN3 polypeptide domain comprises the amino acid sequence of SEQ ID NO: 509, and wherein the siRNA molecule comprises a sense strand 19-23 nucleotides in length comprising an oligonucleotide or a modified oligonucleotide comprising the nucleobase sequence of SEQ ID NO: 1071 and an antisense strand 21-23 nucleotides in length comprising an oligonucleotide or a modified oligonucleotide comprising the nucleobase sequence of SEQ ID NO: 1072.

16. The composition of claim 15, wherein the 5' end of the antisense strand further comprises a vinyl phosphonate modification and the 3' terminal nucleotide of the sense strand is attached to the linker.

17. The composition of claim 16, wherein the sense strand comprises the modified oligonucleotide of SEQ ID NO: 706 and the antisense strand comprises the modified oligonucleotide of SEQ ID NO: 707.

18. The composition of claim 16, wherein the sense strand comprises the modified oligonucleotide of SEQ ID NO: 704 and the antisense strand comprises the modified oligonucleotide of SEQ ID NO: 705.

19. A pharmaceutical composition comprising the composition of claim 15 and a pharmaceutically acceptable excipient.

20. A composition comprising an siRNA molecule comprising a sense strand and an antisense strand, wherein the sense strand is a modified oligonucleotide 20-23 nucleotides in length that comprises the nucleobase sequence of SEQ ID NO: 1073 and the antisense strand is a modified oligonucleotide 21-23 nucleotides in length that comprises the nucleobase sequence of SEQ ID NO: 1050.

21. The composition of claim 20, wherein the sense strand comprises the modified oligonucleotide of SEQ ID NO: 614 and the antisense strand comprises the modified oligonucleotide of SEQ ID NO: 615.

22. The composition of claim 20, wherein the 5' end of the antisense strand further comprises a vinyl phosphonate modification, and wherein the 3' terminal nucleotide of the sense strand is attached to a linker.

23. The composition of claim 22, wherein the linker comprises a molecule having the formula of Mal-$C_2H_4C(O)$(NH)—$(CH_2)_6$.

24. The composition of claim 22, wherein the sense strand comprises the nucleic acid molecule of SEQ ID NO: 660 and the antisense strand comprises the nucleic acid molecule of SEQ ID NO: 661.

25. The composition of claim 20, further comprising a FN3 polypeptide domain linked to the sense strand of the siRNA molecule.

26. The composition of claim 25, wherein the sense strand of the siRNA molecule is linked to a cysteine residue in the FN3 polypeptide domain.

27. The composition of claim 25, wherein the FN3 polypeptide domain binds to CD71.

28. The composition of claim 27, wherein the CD71 comprises the amino acid sequence of SEQ ID NO: 2 or SEQ ID NO: 5.

29. The composition of claim 25, wherein the FN3 polypeptide domain comprises an amino acid sequence at least 98% identical to the amino acid sequence of one of SEQ ID NOs: 273, 301-307, 310, 312-572, 592-599, or 708-710.

30. A conjugate molecule comprising an siRNA molecule linked to a FN3 polypeptide domain, wherein the siRNA comprises a sense strand and an antisense strand; wherein the sense strand is a modified oligonucleotide 20-23 nucleotides in length that comprises the nucleobase sequence of SEQ ID NO: 1073 and the antisense strand is a modified oligonucleotide 21-23 nucleotides in length that comprises the nucleobase sequence of SEQ ID NO: 1050; wherein the FN3 polypeptide domain comprises a cysteine residue substitution at a position that corresponds to position 6, 8, 10, 11, 14, 15, 16, 20, 30, 34, 38, 40, 41, 45, 47, 48, 53, 54, 59, 60, 62, 64, 70, 88, 89, or 90 of SEQ ID NO: 445; and wherein the sense strand of the siRNA molecule is linked to the FN3 polypeptide domain at the cysteine residue.

31. The conjugate molecule of claim 30, wherein the cysteine residue substitution in the FN3 polypeptide domain is located at a residue that corresponds to position 54 of SEQ ID NO: 445.

32. The conjugate molecule of claim 30, wherein the FN3 polypeptide domain comprises the amino acid sequence of any one of SEQ ID NOs: 273, 301-307, 310, 312-572, 592-599, or 708-710.

33. The conjugate molecule of claim 30, wherein the FN3 polypeptide domain comprises the amino acid sequence of SEQ ID NO: 509.

34. A composition comprising a FN3 polypeptide domain linked by a linker to an siRNA molecule comprising a sense strand and an antisense strand, wherein the FN3 polypeptide domain comprises the amino acid sequence of SEQ ID NO: 509, and wherein the siRNA molecule comprises a sense strand 20-23 nucleotides in length comprising an oligonucleotide or a modified oligonucleotide comprising the nucleobase sequence of SEQ ID NO: 1073 and an antisense strand 21-23 nucleotides in length comprising an oligonucleotide or a modified oligonucleotide comprising the nucleobase sequence of SEQ ID NO: 1050.

35. The composition of claim 34, wherein the 5' end of the antisense strand further comprises a vinyl phosphonate modification and the 3' terminal nucleotide of the sense strand is attached to the linker.

36. The composition of claim 35, wherein the sense strand comprises the modified oligonucleotide of SEQ ID NO: 660 and the antisense strand comprises the modified oligonucleotide of SEQ ID NO: 661.

37. The composition of claim 35, wherein the sense strand comprises the modified oligonucleotide of SEQ ID NO: 614 and the antisense strand comprises the modified oligonucleotide of SEQ ID NO: 615.

38. A pharmaceutical composition comprising the composition of claim 34 and a pharmaceutically acceptable excipient.

39. A composition comprising an siRNA molecule comprising a sense strand and an antisense strand, wherein the sense strand is a modified oligonucleotide 20-23 nucleotides in length that comprises the nucleobase sequence of SEQ ID NO: 1074 and the antisense strand is a modified oligonucleotide 21-23 nucleotides in length that comprises the nucleobase sequence of SEQ ID NO: 1075.

40. The composition of claim 39, wherein the sense strand comprises the modified oligonucleotide of SEQ ID NO: 632 and the antisense strand comprises the modified oligonucleotide of SEQ ID NO: 633.

41. The composition of claim 39, wherein the 5' end of the antisense strand further comprises a vinyl phosphonate modification, and wherein the 3' terminal nucleotide of the sense strand is attached to a linker.

42. The composition of claim 41, wherein the linker comprises a molecule having the formula of Mal-$C_2H_4C(O)$(NH)—$(CH_2)_6$.

43. The composition of claim 41, wherein the sense strand comprises the nucleic acid molecule of SEQ ID NO: 678 and the antisense strand comprises the nucleic acid molecule of SEQ ID NO: 679.

44. The composition of claim 39, further comprising a FN3 polypeptide domain linked to the sense strand of the siRNA molecule.

45. The composition of claim 44, wherein the sense strand of the siRNA molecule is linked to a cysteine residue in the FN3 polypeptide domain.

46. The composition of claim 44, wherein the FN3 polypeptide domain binds to CD71.

47. The composition of claim 46, wherein the CD71 comprises the amino acid sequence of SEQ ID NO: 2 or SEQ ID NO: 5.

48. The composition of claim 44, wherein the FN3 polypeptide domain comprises an amino acid sequence at least 98% identical to the amino acid sequence of one of SEQ ID NOs: 273, 301-307, 310, 312-572, 592-599, or 708-710.

49. A conjugate molecule comprising an siRNA molecule linked to a FN3 polypeptide domain, wherein the siRNA comprises a sense strand and an antisense strand; wherein the sense strand is a modified oligonucleotide 20-23 nucleotides in length that comprises the nucleobase sequence of SEQ ID NO: 1074 and the antisense strand is a modified oligonucleotide 21-23 nucleotides in length that comprises the nucleobase sequence of SEQ ID NO: 1075; wherein the FN3 polypeptide domain comprises a cysteine residue substitution at a position that corresponds to position 6, 8, 10, 11, 14, 15, 16, 20, 30, 34, 38, 40, 41, 45, 47, 48, 53, 54, 59, 60, 62, 64, 70, 88, 89, or 90 of SEQ ID NO: 445; and wherein the sense strand of the siRNA molecule is linked to the FN3 polypeptide domain at the cysteine residue.

50. The conjugate molecule of claim 49, wherein the cysteine residue substitution in the FN3 polypeptide domain is located at a residue that corresponds to position 54 of SEQ ID NO: 445.

51. The conjugate molecule of claim 49, wherein the FN3 polypeptide domain comprises the amino acid sequence of any one of SEQ ID NOs: 273, 301-307, 310, 312-572, 592-599, or 708-710.

52. The conjugate molecule of claim 49, wherein the FN3 polypeptide domain comprises the amino acid sequence of SEQ ID NO: 509.

53. A composition comprising a FN3 polypeptide domain linked by a linker to an siRNA molecule comprising a sense strand and an antisense strand, wherein the FN3 polypeptide domain comprises the amino acid sequence of SEQ ID NO: 509, and wherein the siRNA molecule comprises a sense strand 20-23 nucleotides in length comprising an oligonucleotide or a modified oligonucleotide comprising the nucleobase sequence of SEQ ID NO: 1074 and an antisense strand 21-23 nucleotides in length comprising an oligonucleotide or a modified oligonucleotide comprising the nucleobase sequence of SEQ ID NO: 1075.

54. The composition of claim 53, wherein the 5' end of the antisense strand further comprises a vinyl phosphonate modification and the 3' terminal nucleotide of the sense strand is attached to the linker.

55. The composition of claim 54, wherein the sense strand comprises the modified oligonucleotide of SEQ ID NO: 678 and the antisense strand comprises the modified oligonucleotide of SEQ ID NO: 679.

56. The composition of claim 54, wherein the sense strand comprises the modified oligonucleotide of SEQ ID NO: 632 and the antisense strand comprises the modified oligonucleotide of SEQ ID NO: 633.

57. A pharmaceutical composition comprising the composition of claim 53 and a pharmaceutically acceptable excipient.

\* \* \* \* \*